United States Patent 12,576,115 (BACTERIAL COMPOSITIONS FOR TREATING AND PREVENTING HALITOSIS) - sequence listing, part 17

SEQ ID NO: 28 - DNA, 4232400 bp, Bacillus licheniformis (residues 2,116,201-4,232,400 of 4,232,400)
  source 1..4232400: mol_type = genomic DNA
gaaagcttcccggtcggctccaaaattgcatatgaaacatccccgattcgttccacattcttatctctcagctgcgtcatcaaatcatcgtaattatagcgctgtgtcctcatggcgtgttcatcaatttttccgcggtctatgataatcgtcggttttccatcgagaagccggcggattttttgatttttcaatgacagatatgcaaatataacctggatcagcgtcaaaacgagaatcgggatgatcgtatggagaaggtggtcatcgagattttcaatagccaaaaccgcgatttcggccatcatgataaaaacgacaagatccagtatgctcagctcgcctatttccctcttccccatcaagcgaaacaaaataaagatgatgaaatacaaaacgatcgtccgaaacgtaagagctaagatttcatccattacggcccgcctccttccgcctatcatgatcataaacatagcctttgttaatttgagtcttttatgtataaaaggtcgggggagctagtctatttgcgaaacatgcagaatacatttaaaaagacgagcccgtctattttgaaaggaggatcgtgatgaacgaaccaaaacaagtcggcaaagggattttatacagcttggtggtcattttcgctttgatgtttgcaggaagcctgcttatttcgctgctccttaccttcacatcattaaccgaaagttcattcagctggttgattaccgccatatcttttattaccttgttcatcggcggttttattgcgggaggaaaatcgaaggaaaaggggtggctgagcggagggttgacagcgctttgcttctcccttacggtgcttttgtttcaatatctcggctttggagaggccttcaatttgaagcagctcctctatcattccggctttttgggagtcagcatgctgggcggggttttcggggtcaatctgcaggggagccgtgcataaaggcagcaaaaagggagcggatgtccgctcccttttcccagtgcccgcaggcttctttcgtcattcacatcagaaacaaatgcagcttcctaaaacaataaggaacggcgcttatagcgcgcggacgtccccgtccgaacagcgccgccgtcacgtcgtgtgaaagcccgatttccgatgtttatgtatctttcggctattctgctgacgcctctctgattgcgcggcggtcgaatgtcagacgggtattgtcgcctgttttgatgacaaccttgctttcgtcaattgaatccacgatgccgtgcaggccgccgatcgttacgaccttatccccttttttcagctcctcctgcatctggcggacagccttctgctgcttttgctgcggacggatcaaaaggaaataaagaaccgcaaacattaaaataatcggaagtaatgttccaagcatctccattattttttcacccctttcaaatggctttatcgctttcttcgtttatgtgtcagaaacttttagcatttggtttattaaaaccgtagcgctcaaaaaactcttcccggaaatcacctaaacgatcttcacgaatggcatctctcacttgccccattaattttaacagaaaataaagattatgataagaagttaaacgaattccaaacgtttcgttgcagcggattaaatgtctgatataagcgcgcgagtaattgcggcacgtatagcagtcgcactgctcatcaatcggcctgaaatctctttcatattttgcatttttgacgacgaggcgcccttcgctcgtcatgagcgtaccgtttctcgctatccttgtcggcagcacgcaatcgaacatatccactccgcggatggctccgtcaatcagtgagtccggtgaaccgacacccattaagtagcgcggtttatccgctggaagcagcggagttgtaaactccagcacacggttcatcacgtcttttggctctccgacggatagtccacctatagcatatcccgggaaatccaatgaaatcaagtctttcgcactttgttttctcaaattttcgtactcgccgccttgaacgattccgaaaagcccctgctcgtcagggcgattgtgagctttcaggcacctttccgcccagcggctcgtgcgttcaacagacttcttcatataatcgtactctgccgggtatggcgggcattcgtcaaacgccatcataatatccgagccgagggcgttttggatttccatcgctttttcaggagataaaaacagcttgtctccgtttaaatgattgcggaaatgaacgccttcctcttcgattttgcggaactcgctcagggaaaacacctgaaagccgcctgaatccgtcaagatggcgcggttccaattcataaactgatgaagcccccccgcctctttgacgatgtcatggcccggtctcagccaaaggtggtacgtattgcttaaaataatgcctgcacccatttctttcagctcttccggcgacatcgttttaacggtggcgagcgttcctacgggcataaacaccggcgtttcaaaagagccgtgcggggtgtgcactctccccagccttgctcctgtttgtttacatgcttttatgaactcatagcgtatcggttgctgcgacaaattatgagccctccaatctttttgaattttatttgatcaacatggcgtctccaaagctgaagaagcggtattcgtgttccactgcggtccggtaggcggaaagcacatgctctctgcctgcgagcgcgctgacaagcataatgagggacgatttcggaagatgaaaattggtaatcatcccgtctattgcccggaatgtgtagccgggatagataaaaatcgatgtccagccgctcgcttcccggaagcggccgtcatgctcggaagcgattgtctcaagcgttctcgtcgatgtcgtgccgacggaaatgatccttccgccttcctgtctgacgcggtttaacaatgctgccgtttcttccgacatttcataaaactcggcatgcatgtcgtgttcctctacattttccgcactgacaggccggaatgtcccaagaccgacatgaagggtgataaacgcaatatgcacgcctttttccctgagcgcatcgagaatctcttccgtaaaatgcagcccggccgtcggcgcagccgccgatccttgtttctttgagtaaaccgtctgatagcgctccctgtcatcgagctgttctttaatataaggaggcagaggcatttcaccgagcgactcgagcacctcgtaaaaaatcccttcatagcggaattcaatttttctgccgccgtgctcgagctcttctgtgcagaccgccgttagacggccgtcaccgaacgaaagaacagttccgcgcttgacccgctttgcgggcttgacaagcgtttcccagacgtccccttcctcctgttttaacagaagaacttcaacctttgctcccgtctcttccttgactccgtacaagcgggccggcagcaccctcgtatcgttcagaacgatgcaatcgcccgcgttcagaaaatcaatcacgtgcttaaacgtgctgtgagtgatctcccctgtttttttatccagcaccatcagcctggacgcatcccgctcttttaaaggaacctgtgcgatgaggcgttcaggcaagtcaaaatcgaataattctactttcatcttttttcaccttactctatctatagacttgaatatcgcatcatttcattcgtccgaagaatgaaaacacgacggacagaatgatgctgatgacaatgcatgtaacaaccggaaagaaaaacgtcacgtttccctttttcacaaaaatgtcgccgggaagcctgccgatgacttgcatgaataaaccgatgccaaaaatgacggcgcccagcaccattaaaatctttggaaattcagtcatggttcggaacctccattttaaagtggctgtaaacatcaggggttacgatgcgcccccgcggcgttctttgaataaaaccgatttgaagaagatacggctcatacacatcctcaatcgtgtgagactcctcaccgatagtagccgaaatcgtatcgatgccgacggggccgccgccaaatttttcgatcatgcccatcaaaagcttgcggtcgatatggtcaagcccgagtttatcaacctggaggcgttcaagcgcatcaaccgccacttcctctgtgatggagctgtttccaagcacctgggcaaaatccctgaccctccttaaaagcctgttggcaatccgcggcgtccctcttgaccgtctcgcgatttcgagagccgagagcgaatcgatgtcgacttcaaacagctctgccgttctgatcacgatctctgaaagctcatcacgcgtgtaatactcaagcctcgacagaacgccgaacctgtccctgagaggcgcggttaaaagcccaacccttgtggtcgcgccgacgagggtaaaaggaggaagatcgagcctcacagaacgtgccgacggtcctttgccgatcacgatatcaaggcagaaatcttccatcgcaggatacagcacctcttcgatcgaacggtgcaggcggtggatctcgtctataaataaaacgtcacctggctccagagccgttaatatcgccgccaaatcaccggggcgctcgatcgccggacctgacgtcgttctgagattgactcccatttcgttggcgatgatcgcggcgagcgtcgtttttcccaatcccggcggcccgtacaataagacatggtcaagggtttcctcccgcattttcgcagcttcgatgaaaaccttgaggttatctttcactttttcctggccgatatactgagcaagtctttgcggacgcagactttgctcaatcgctgattcatggttgtctagttcacttgatacaagccgctcatccatgatatcaccttactttaacaatttttgcaatgcttttttaacgtattgatctgtcgaaagcgcctcttcctttttcaaatgaggctggacttttttaatttcccgatcggaatagccgagcgccctcaatgcttcaagcgcttcctcaagagccgttgccgcttcatgaatttgctcccgctcttcatggttaaacagatcggcagcgatttcaggaacggcatccgcaagcttccctttcaggtcaaggatgatctgccttgccgtttttttgcctacgccgggaaatttgacgagaaatgcttcgtcctcattctcgatcgcttcaatcaccgctcccggatcgccggaagcgaggatcgcaagcgctccttttgggccgatccccgtaacattcagcattttcgtaaacagcattttttcttcccttgtcgaaaagccgtacagcgcattcgtgtcttctcttacataatggtatgtatagattgtttctttgctgtttttcttataaataaacggatttggcgtgaagatctgatagccgatcccgccgttttcaatgacaatatattggggcgatacataatcaatcgtcccttttacgaattcgatcaacgttcattcacctctttgactgctcttcattgtaacacaaaacaggcaaagctagaatgaaaaagttaacatatgttcgctaaaaaagcttctgtctgcagctgaaaaaagacataacagcgtcatgtcttcatatcttctacatgatgttggcttccggatgattttacggcttcaatgacatgttcaaattcctttttcgtgcggtatggtatccctttgcgcagatcatccgccatccggctttccagccgctttatatcaatctgaaaaaacgattgaatgggttctgataagatgcccgggcgaccgtgaaaagtcgaaatcacgccatcttcagtcactccgatataaccgtttgttttgctgaggggagaaatgtcgtccacctgtttgcgaaacagaataaacccctttttctgatcgatgagctgccaccctttataagcagctttaaagtcttccagtgtgcgagcggcctctactttattctcaattccaacgtctccgtccagataaaccttttcaagctggatttgaactttagccggcttttcggccaaggcctccaggtgaaagctgagcgcggccagcagacttccaataagcaataaaccgattttgaacttgcttcggctgtacatcaatatcaccttcttttttgccttaacgatcatatccttagtttgaccaacgcttttaaaaattaatctaaaaaagcaagcgatctctttttagatgacaaccggtttacgaatgttacattttcaaaccaatatgaagaactcaaaagcatttaaggtgcaaaacagcccattctcatgtataaacaacattatagagagtttttcgtttgaccagcccttaaaaagaaggtgagctcagcgtgaaaaaggcgcatacctatgcagaagccgtaaagtatgatacgaaaaaaaagttcaacaagcttatccaaaaacccgatgacttggaattgatcgggaaaggcaggagcgcatacgtttttaagctgactgaagagggcggcagggaaatggctcttaaagtcttttttcctgaatttaagaacatcgccgcaagggaagcggagatttacaaaaagctttctgattcgaattattatcctgatatatatgaaacagggccatcatatattttaatggagtatattaaaggatatactttttatgagtgtttaaacaaaggcattcggatcgatgatgacatgatctgcgaggtcgaccgcgcattgaacgatgcgaggcggaaaggattgaatccatccgatatccacctccgaaacctgatactgacgccgtctggaacaatcaaagtcatcgatgtcgccagatttttgcagacgaaagaatgcaggcagtgggatgacttaaaaacagcctatcaaaccctttacaaaaaaagccgtttcccgcagaggcttcctaagatgtggatggaattgatcgcttatctttataaaaaaagctggcttcaaaaacaatgggcctccagaaaaaacaaatttcacccgtaatctgaaacttataggaagcatgctcgtatatgaaataaccccattaccgtcaagaaaggagaaacattcgttgaagaaaaaaaataaacgtaatgatgacaaatgggattatctttatctcgtcgatttgcttgagccattgttttatgtgctgaggctggcagtaagaggacttgcgaaaattataaattaaacactcggtctttcgggtgtttttttgatggctgtgtggcaggcaaatccaaaacaaaaccccttcctcagaaggggtttctttttaatgttctttcaaatttgcgagcggcacttcctgctcgttctccggctggccgagcggaaagattcttgcggtttcattttgttcgtcgacacgctgaatataaatcggcctgccgttataagtaacatcaaccatatcgggtgattcgacgatttcctgggcacgctgcgtattcacctgacaccctcctttagcttttactcataatgtgtactcccgggtgctttcgtattcctttttaaccggttttctttcaaggagggctctcaggatcaatgaatctttacatacaaaggcagatccgtgtgtcccatttcacggacataaacaaacagattgcctttgtggtgtatttcgtgtccgatcgcgagctgcagcagctgttcgccggctacttttcgtccgaagacgccggtcaaatcgacttcacgatccaattcttcatccgtaaaggattcaagcagcgtttttgttttttctgtatacgttttggcaagctcgctcaagcttgtccctgtttcttcgggcttctttttaaaaggctctccgttcccttcctttgccgccgaagcaaaggtatagaaagattgcagcatatgcgtgacaagttcctttgctggcatcgacgtttcagtcggtttgtaatcgagatgtttttcatcaattttttgaatgagttcttctgtcacaaggcggtgggacataaattcctgaacgatgcggtctttccgttccattcttttattcctccttcatgttttagcagttcatacacagaataacatgagtttccattttcagcatctgtcctgcagcaccttgcggaccgccttgacatattttcggaatgttctcgtttttgtctcttccctctctttataggaaaagtcttcgaaaaactctttcctctgagccgtgctgatttcaagctgcacgctcattcctgtctggctttcattattgatgttttcctcagcagttccggcaaatttcccgtccactttgaccaattctgcggaaaagtcagactttttcagagatttgacgatggcttttgccagctttctgtccgttcctcccacaagcgtgtgcggacggtcgcccgaatagccgtggaatgcgatggtatagcggtgttcttttattttctgcaatgccagaggctcgtcaaagtttgtgctggtaatatgaagatcggagttgttctcatccttttttccttcgaataaataagttgaataatcatcattaaaagctcggacaagctcgctcactccgccttctattcttcctccatggggcgaaaagattaaacagtcgcttcccgctttttcgtgataatcaatgtcatagccgcttttttcgttttcctgcaattccttgaagttcttgtatttgtccccggcctggatctgatagctttcccgggttgttttttcggaccacctgtatacaccatttatcatcactgctgcgatcaccaagtagatgagtacttttttcttcattggttattccccttttacactacctttcgatttataggcatgtcctccatgcctcattgtatatttggcttttttgtgacacagttattttacgctttagacatgacgcgttcaattatgaataagtttgataaaaaataaaaatttaaatatttttattaaaacaatactttttctttagtttaaaagatcgataaattttaagaagaaaatctcataagaatgggctcctctggttgcaggtttttcccaaaagcccatccagcttgagaatgaagcattctatcaggaacggggtatacggtttgataaaagtgagaatcatctgcggccgccaccggcagatgttatattttcttttctcccccgttctgttatcctataaccgacaataaaagtgcaggtgataaaacatggaaacagaatatgaaacaaaaggctacgacctgacaaaagtttatgattacaatcaatatccggatgtccgccacggacggtgcgacaattgcgattacaccctttttaaaagctctgtgaaaaacgggcagtttttgcgcgaatgccggcgctgcgggatgaaaaaaagcatttgaccgttacagcaaaattttcgtatgtataaaaaaaacttgtcgacaaggctgaatgcagctttgccgacaatattatcatgctgtccaatatttaagcgtctttttgatctttgcttgtgacgatgccttggatcgattcaccgatctttccgctgagatcggcattcagattgttgagattttgaatgtattcgctgataatattttggatcgcttgattcagttccgcattctcgctttttgtgaagtcagcctctctcagatcgatgccgctgtttttctgtaccagctcatagatggattcgccaaatccggtgataaggctgccgactctctcgatgatttgagcggtttcctgatcttgcgcaccggcgcccatagccgtgaaaggcttctcatttccttgctgttcagccatttatagatcctcctctcatagatgacagattccttcacaatatatgatcaaaaatcaaatcatgtttccgctggagcttgatacggctgctaaatggtttgatgaagcataaaaggacaccgctaatcttgagcggcgcccttttctttaatgaacgttcgtatacacttcctgcacatcgtcatcatcttcaagcacgtcaatgagcttttcgactttttcctgaagcgcttcatcgacttctgcataggtttgcggaaccattgtaatttcggatgttgccagcttgtagccgcgctcctccaagcttttcttcacttcttcaaactgttcgggctctgtataaatctcgaacagctcttcgctcgtttcaagctcctcagcaccggcatcaatgacctcaagcataaactcttcttcatctatctcaagatcttcacgttcgattgcaatatatcctttccggtcgaacatataagaaacgcatcctgtttctcccaagctgccgccgtttttgctgaaagcggttctgacgcttgtcgccgtccggtttttattatctgtcaaacatttgaccatgacagccacaccgcttggtccgtagccctcatacgtaatttcctcatagctttttccatcctggctgccggaagcttttttgatggcgcggtcgatgttgtcatttggcatgtttgcatttttggctttatcgatgacgagacgcagacttgcgttagattcgggatctggtcccccttctttcgcggctacatatatttctttggcaagcttcatgaaaattttgccgcgtttagcatcttgggcattttttcgtctctgaatatttttccatttagaatggccagccataactttctacctccaaaataattctcgtctctatgtacactttatacggttttccccgtttttgtaaaggaatcggccgagcgcttataaaaaattgccggggaatccccggcaattccctgcttgttattggttccgcaagcggttcaaattgttattcgtcgtgtctccgcgatccctaatgttctgaggatcatcgttcatttcgcgcagccttgtaaatgcgccgtcgtcctcgacaacttgaacggtccggtctccggcaaatgttttggctgcttttctaatttgagttctctcgttatttgtcagccttttatcagaccgtacggcgatgatgaccgtttcattcgttacgactgcctggctttcgtcaacataattcaatttgttgacgcgcccagtgatattccttgagattttacggttttccggtctgtcatagcctgtatccgccgtattcaccaaatggttgtgataattcatgtctccccggctgtaagttccatcgcctgttggaacgggattgccgttgcccgctcgattgtttacgtttgttgcaccgtttctcccgttcatgttttcaagcatttctgtaacaggaccgtcattatcaagacctgcattacgatctgcatcatttgaataatatccgatcgggcgcgtattgtttccattatctatagcgtcgttcgttccgcatgcagatagacctgctgtcaaaagcaaaatccccgaaaacactttcagcttgctgtccaatggtagtaccccccgtgaaaaccgctgaatttgagcattgcgctcttttttaggatgtgcgggatgcgaagagttacccttgacagttatagacattcccgttaaatagcatgaaaatgtttatagcggtccacaataaaaaaggaacgatagatcatcgtcccattccgaatcagtcttcatcatcttccggtctgttaaacatctgtccccctgcaggctgctgtccgtatccccccataccgtacggagctcccatttgcggcatctgtccatatggcgccgcacctggaaaacctcccgggaattggcccggcccgcacccgcagtcatcttctttgccgtgtgccatattagggtccccggcgtgaccgacgtttggcggtgcaaatcccgggaacggctggtaaggcgcatatgccggggcagtcatcggctgatgatggtatccgtgatgaccggcattgtcatgccccatgttgtcatcatcgtcatattcagcaggagatacatagctaggctgatgcatataaggcatttgagcaggatatggataccaaggatggcacaatcccgatccaggcagcaccggtgaaacaggaatccagcagcctccaggatagaacggataaggatatggatggtgatgatatcccgctgcagctacattcggcatgccgtgaaactgcttattttcatcacctgctgcaccgacatttggcggctgcggaacattcggataattgacattttccatatggttttcctcctcatttgtccatggattatacatgttggggcctttctcttgatgttcataaggttttggaggtacgtacggctgatgaagctgattgacgctttgatacaaattcgaaatgtcgccttcaggcaaacttgattgtccgatgttcgggacaggcggaacataaggaaccgaaggcttttctttcggttttatatcttcaacatcaagcttgcttttcggcttttcttttgcaaatggatgttcctgctgttttttcggtaattcctttcgcatattgagctgttcttcttttttgaccggcactccccctgacggtactttgattttcatgcccggcatgatcaagtctggattgctcagctgcgaattcagctttttcagttcttcaaagtccacttcatatctttccgcgattttttccagagaatcgcccttttggacaatatgaattttcaacgttttcccctcctatgcaaaaacgtgagaacgaacagatgagaataacaaatatgcttctccacaaatttatgcgcatagcggaggggttatgataaaaacttgttctccaaaaagttaacggatcgttaacatccgattcagcgcaagaatggcatcttttgcaatatcttgatccactttgatcacgcctgtcggttcacctttgtcgatctgctccagcgaccacagcaaatgcggcatgtcgattctgttcattgtcaaacaaggacacatatcagggttaagggattcgatttgtttatcaggatgttcttgaatgatgcgtgaaacaaggttcatctctgttccaatcgcccatttgctccccggttttgcttcattaatggagtcgatgattttttttgtagatccgctgaaatcgctgagcgcaacgacttcgtgggtgcattccggatgaacgataacattgatgtccggatcccgctctttaacacttttgatattcgccacggtaaatttttcgtgaactgaacaatgccccttccacaaaatgattattatgtctttcatatcgccgttatactcaagtttttctgcaattggatcccataccgccatcctgcttagaggaatgccgaggtcaaatgccgtgttgcgtcccaagtgctgatccggaagaaataaaatcctctccttttgcgatagcgcccatgtcaacatgcgcgccgcatttgaggatgtcacggacgctcctccgtttcttcccacaaaagccttaatttcagctgtcgaattgacatatgtgagcggaatgaccgtatcgccaaacagcttcgtcagctcttcccaggcgcgatttgtctgccgcatattggccatatcggccatcgaacagcctgcgcgcatgtccggcaaaacgacaatctgttcgtccgaagtgagcatatcggctgtttccgccataaaatgtacgccgcagaacacgatatattccgcttttttatttttttgggcgacctgtgccagctggagcgaatcgcccgtcgcgtccgcaaattgaatcacttcgtctttttggtagtgatgccccgggataaacagccttgctccgaatttctttttgattttcaaaatccttccggccatttcttcctcagtcaattctttatacacctccggcatcatgccggcgttcctgtcatgaatcacttttaaaatagacatctgtaccctctccaatcccgcttattttttcagatcaacattcatgctgatatcaaggcttttcgccgaatgagtcaagtagcccaatgaaatacagtgcacccctgttcccctgtaagcggggagattttcaaatgaaattccgcctgaagcctccgttataatgccggcgggtgtcatttcagcaaatgctttcaccgtctcgggcgggcaattgtcgaacataatgatatcggcgccggcctcaatcgcttcatgaagctcttgttcagattcgatctccacttcgatcttgaccatatggccgcacgctgaccgcgctttttcaaccgcttttgaaatcgagccgcaggcggcaatatggttgtctttaatcatgatgccgccgtccaatccaaagcggtgattgctgcccccgccggttttgaccgcgtatttttcaaggatgcgcaggcccggggtcgtctttctcgtatcgcaaatcgcgatattcggatcattcagcctgataatggactgctttgttaatgtggcgatcccggacattctttgaatgagattcagcacaacccgttcaccggtcatgagggaagctgcacggcctttgagtcgcgcgatcgtttcccctttacgaaccgcttcgccatctgttttcagcatgtggacggcgatcgtttcatcaagcagccgaaagccttccagaatcactaattctcctgcaaacaagccgtcatccttcgctgtgatgacagcttcgcattgatgattgtcatcaaaaacggcttctgaagtgagatccccccggccgatatcttccttgaaaaattccttaagcatgttcctaagtatgaaccgctgcatatttcacaatcccttcgttttgtctgatcttgatcccgccttttgtgtgaacgatttgcttgccgtgccagtttttatcatcaggcgccggacaatccgaacggtaatggccgcccctgctttctgtacgaagcagtgccgaggccgtcatctgtttggcagtctgccataaatgagctagctcgagctgttctattgtgatttctttcacatttacgatttgaaccggcattcgctcaagccattctttcaccttcgtcaattcatcctccgtacgcacgatcgccgcataatctgtcatttgtttctgaatatccttcacatctgtcaaaggaacagaatacgtcacattctcaggctgaggagattggcctctgacaggctccggtttttggcaggcttgaatccgctccgccgctctccttccgaagacgatgcattccaagagagaattgcttgccagacggttggcaccgtgaaagccggtgcaagcggcttccccgatcacaaaaaggtttggaacagccgtttctccccatttattcacagaaacgccccccattaaaaaatgcatgcccggtgaaaccggaatccggccctcttcaatggaaataccggctttttcgcaaagagaagaaatcgtagggaagcggcttttaaagtctgatatgcgggaaatatctaaaaatacgctgcttccgcaggcaagcttttggtgtatcgcccgagatacaacgtcccgcggcgctaaatccagcaaagaatgtatgccttccatcacccgctgtccgttttcatcaatcaacacagcaccttctccgcgcacagcttctgaaacaagtccgtgcgcgcgcccgtctttgacaagcaatgtaggatgaaattgaacgaattccaagtctgcgagctctgctcctgcccgatacgccaaagaaatcgcatcgcttgtcacagaacggttattcgtgttgatttgaaatagatttccgcagcctcctgccgccagcacgacaaaatcggcttttctgagaaacgtcttcccacggctgtctttcgtccagacgccacagcagcgtccgtcttcaatccataaatccgccgccgtttcgtattctttcagcacgacgtgcggaccgagccgtccgattaagtgccggatcaactcctgtcctgttgcgtctcccccggcatgcaaaattctgttcaccgaatgcgcgccttcttttccgaggctcagctttcctgattcgtcagtatcaaaagggaaatgctgaaggatcagctcatcaacaaggcgctgtccgtctttaatggcatcatggaccgcttcgatttgattgtggccgcacccggcatacaacgtgtcgtccgcatgaagcgaccaggaatcgcgaggcaatacagcagatgcaattcctccctgagcgagggttgaattgctgtcttttacagatgcttttgtcatcacaaccacttcataagacggcggaatggatgcagcaaaagacaacgctgcggcacctgctccgacaacaataatcgtctgatgagacatgtcgactcctcctgtaagtttacatgtgtcttgacacctatatttacacatcgataaaataaactcaagtattttttataaagaatgggagacgagcgccgtgatttatcttgattatgcagcgacgacaccggcatcaaaagaagccttggacgcgtttcaaaaacttagcacagacgtatacggaaattcgagcagtctgcacgatgcaggagggaaagccgaaaacattttgcgctgctgccgccaaaggatggcagaacttttatccggagaagaagaaggcgtttattttacgagcggaggcaccgaagccaactttttagcgattcactccatcttaaatggacttcccgccgggaaaaagcgctttttaatgacagaaatggagcatcagtcgatccatattttgaaacggcatctcgagatgctgggatttgatgtcgacttgatgaagccgaatgcttcaggcatcattacaagggatatacttgaacggcacctccgcccggatacgggtctggtttcgattcagcatgccaattcagaaacaggcgtcatccagcctctggcaaagctctcggcttacctgcataagcgggacgtgctcttgcacagcgactgcgtacagacatttgccaagattccggtccgcattgatgagctcggcgctgatgccttatcggtctcaagccacaaagtatacggcccaaaaggagttggggctgtctatattcggccgggtgtaaactggaaacccgtctacccgggcactttgcatgaaaacggctttaaaagcggcaccgtcaatgtccccggaatcggcgctttcattaccgctgcagagtcgacaataaaccgcatggatgccgcgcatctcaaattccaggagctgcgcgcaggttttctggaaggagtaaaagaccggaagcttcccgtctcccttgctgtgcccgattcggcaaattcgcatgttctgccgcatattataggttgtttttttcattcctttgaaggacaatatactatgctggaatgtaatcggagaggaatttgcatttctaccggaagcgcgtgttcagcgggctatcatgagccttcgaatacgatgaaagcccttttgatccctagggagctcgcgcttcaattcgtccggatttcattcggatgcgatacgacaagcgaacatgttgataggctgttggacgttcttgaagatatgatgaatgagaaaggagaccatcggattgacagacggattaaaacttacgggagctgagcggcgccagcagctgctggcttggctgaaggagtcagaggctccgcttacaggaagcgagctggccaaaagagcatctgtttcacggcaggtcatcgtacaggatatttctttattaaaagcaaaaaacgaaccgatcatcgcaacaagccaagggtacatgtatttgcggtcagccctcggcaaaaaacagccggttcagcggatcatcgcctgtgaccacgaacccgaaaaaacggaagaagagctgaatctgatcgtcgactttggcgtaacggtgaaagatgtaacgattgaacatccggtctacggagacttaacagcttcgatcagggtcagcacaagaaaagaagtcgcggatttcgtcaaaaaaatctcttcgacaaacgccgcttatctgtctcagctgacaaacggcatccatctccacacattggaggcagatgatgaagagaagatcgaacaagcttgcggcgccctgcaaaaagcgggcatcctcattcccgaataaaagaaaaggtcctttgccgttatcagcgcaaaggacctttcttttatagtgtatatgcgttgtaggcaccgagcattttcaccttgcagcccaaagcttcaagctcagctattgcacctggaatcagcacgtcatccagggccatttcaatatcaataatgaagaaataattgccgagaccggtttttgtcggccgcgattcaattttagaaagattcaaatttctccaggcgaaagccgacagcacttggtggagagctcccgatctgtccgaaggaagggtcaccagcaaagtcgttttcggtcttcccttgagttgagggttgaccggaggggatgcctcgcgatccggatgaagcatcacaaatctcgtgtgattgtattcatagtcatgcacatctcttttgacgatgtctaatccgtaagtatctgctgccatttcattggcgatcacgccgatgttctcttccggattttcgctcacgtattttgcagctgctccggtggatgtcgcatattcaaacggaatggagcggaaccggctgtgcaaaaatttatggcattgcgcgatggcatgggaatgggaataaaccttctgaatgtcttcccaagcctcttttctggtaggatgcacaagcaaatgctgacggatgggagcggtgatttctccgacaatataaagaggctgttcgtgaattaagtagtctattgtcagattcaccgatccttcaatcgcattttcaagcgggacgacagccagatcgatctccccgttcatcgccgcatccatgcaggccggtatcgtgttaaatgcttgctggtctgcatctgaaaagcaggagcagacggcaaggtgcgtaaaagttgcttctggacctaaataacctactctcatactcatgatatatgtcattctctcccttaagcgcccgaacctagtatttcgaccttttctacgaattccagctttcttaatttgttcatcagcaaatcgatattttcatccatgcctctcgtactgacagagagcgtgacattcgctcttccttgaagagggatggtctggtggatcgacagcacattgcagcccgattcagctaccacttgcagcagatgggacagcgttcctgagcggtcctccaaatgaaaaaaaagcgtgataatctgttccttgaccatcgtataaaaaggaaaaaccgcatctctgtacttataaaaagcgcttcggctcaaatctaccttttgtacggcttcagctacagattccgcttttttccgctcaatcagctttttgacctcaagtgttttccgcattgcctccggcagcacgtcttccctgacaagataaaaggtctcctctttcacagacttttctctccttttaaaaaccctgattcctttacattgatcctgcgaaaggaagggcgttcctttcagctaaaagtcggagagcttgcttggcaaactctccggtatgatcagtcgataaattcaaattcaaattcgagaagacggatcgtatccccgtcttttgcaccgcgggcccgaagcgcatcatcgacgcccattccgcgaagctgtctggcaaaacgcttaacagactcatctcttgaaaagtccgtcattttaaataagcgttcaagcttggctccgctgagcacgaaggtgccgtcaggatcacggctgatctcaaacggcgcttcctcatcctcaagcttatacatgactctgttttcagccatgtcttcttcgtcgtagagcgggaattccggcgtcgtttccaaacggtcggcaatttcaaacagcagatccctcaagccttgtctggtcaccgcgctgattggaaaaacaggataatcatctgtgagcttttctttgaaagccttcagattttcttccgcatccggcatatccattttattggcgacaataatttgaggacgttctgtcagcctgagattatactgttcaagctctttattaatggtcacataatcttcatacgggtcgcgcccttcaagacccgacatgtcaataacgtgcacgatgacgcgcgttctttcgatatgcctgaggaattggtgtccgaggccaactccttcgtgcgccccctcaatcagtcccggaagatccgccattacaaagctgcggccgtcttccgtttcgaccattccgagattcgggttcagcgttgtaaagtggtaatcggcaattttcggcttggccgaagacacgacagacaggagcgttgattttccgacgcttgggaagccgacaagaccgacatctgccaaaactttcagctcgagaacaatatagcgctccttgccgggttcgccgttttcagaaagctgcggcgccgggttggcaggcgtcgcaaaacgtgtattgccccgtccgccgcgtcccccttttgcgatgacggcttcctgtccgtgctccgttaaatcagcgatgacctgttttgtatcatcgtcaatgacaaccgtgccgggcgggactttcacaaccatgtcttcggcatttcggccgtgctggtttttagacatgccgtgttctccgcgcgctgccttaaaatgtctttgatatctaaaatccatcagcgtgctgagaccttcgtcaactttgaaaacgacgtctccgccttttccgccgtcacctccggcagggcctccttttggcacatatttttcgcggcggaaagcaaccataccgttgcctccgtctccgccttttacgtatattttcacctgatcaacaaacataatgtcctccgttctattcctaaaaaaccgctttacttgatatgaatttcggcgatgcactcacggtctgttacatcaaaccgcttgatttcataaaagtcggccagtgaatgatgaaagtctttgataccggtcagctttgtgaatacgccgtggaaatcgagaaagatgacgaggcggtcgtccggaccgtccgtctgcagcgtgatcgtcagatgattgtcgctgcctttcaaaacggcatcgtcaaaaatcccaaacagctttctgatgagaacgacgagcctttcttcataagctgacaaatccttgacttgaccgatcacctcatattcaagcgtcagcgaatgggccatccagttaaatgtaagcagctcatacgccgcgcgcgggattctaaggtttgaaagctttgattcatgctgagcttcgatgaccacttcatcgataatttcaaatacgcggtcatacttttttaatgttaagtttcctttaatcaattgcagtttattcatccagtcgtgccttgagtggctgagcagatggataagctcatgggtcaaagccttatcgtccatattcttttctcgttttttcgaagtttcttccattttggcactcccaatcgtttggtctctcttttaggagtctgattcagtttgtactttgaattataacagagaaggcagtataaatgaaacacgtttatatactttaacgaagcagaatcagagcggaaacccggccttatttaggcgtcgggaaggtgttttaagcaagtcatggtgctgaatgtaaaaaactccggtcagaacgaccggagtttcgtttaaaggttaggctacaggatatacgctcacttttttgcggttacggccgaaacgttcgaatttaacagttccgtcgacttttgcatatagagtgtcatctccgccgcgcccaacgttttcacctggatagatttttgttccgcgctgacgataaaggattgaaccgccagatacgaattgaccgtctgcacgtttagcacctaggcgcttcgcctcagagtcacgtccgtttttcgttgaacctactccttttttagatgcaaaaaactgaagatctaatcttagcatgtagctcacctcctatattttgttcgtcgttacttttaagtaacctttgtagtctcgttcgatcgtgtcaagggagacgatcatgccttcgagaaggagctgcgccttttcaaaagcctcacgatccgtaccgtccgggaagcggaaagataaaaacccgccgtcttccccgaggtcaatgaccggctcaatgcccgtcagcttcattacggcattgacggctccaaaggcgaccgccgacgcccctgcgcaaacgagatcctgaccatgttcagcaaaattcgcatgtcccgacatttcaaagcccaagatgtctttgttcgatcgggatcttgtaatctttgcatgaatcatatcatacacgccttaagcgttgattttttcgataacaactttagtgtaaggttgacgatgaccttgttttttgtgttggtttttcttcggcttgtacttaaatacggtaatttttttagcgcggccttgtttttcaactttgcctgttaccgtagcaccttcaaccgtagggctgccaactttaacattttcaccgccgacaaacaatacgttgtcaaaagtaactgtttcgccggcttcagcagcaagcttttcgacgtatacagtttggccttcttcaactttgatttgttttccgcctgtttgaataattgcgtacatctctgcacctcctaataaactaagactcgccagtcacagggggctaagaaagcacttaacgcctgtgctgagcggttgtagcacgggtgctacatccataacattaaaaaatataccagaaaagagcccgagtgtcaatgtcttttagaaggatggtcaataaaccagaagcagatcttccattgaggaagtcgtgcgcttgtctgtaaaataagcgtggagaacttcattttcatccagctggctcagtttttgtccgtccttctcaataatgatcgggtgtttgcagccccttttaaacatgagcatgacctcataaatctgctgttcggcgcacaccgtgatcggtgcgagtcgccgcacttccctctcatttccatagtagcgctcaagcaaaaaacggatatgggcgtaatgccgattgcgatattcctggtaaagggatgcagccaaaaatacgagaagcacccaagcgctcagctgcgacggggagaccagcagagtcgccgcgattagaacagcgcagcaaaagcacgatacagccagcatcatccgctgcgctttctgatacggaaggtgttttgaaaacagcagaaacagcagcttcccgccgtcaagcggccaaataggaaacagatttatcaagaggatggtcagattgtaaaaagtaaacgtttcaaatatatgagggctgatgagcgaattgaccgccaaaagccaggctgcaaattgaagccaaatgtgctgaacaggccccgcggcgatgacggcaagctcttcctttaacggtctgttgccgtgttcatcgacttccagcgttcctccaaaaggcagcaggaaaatgcctttaattctccatgaaaaataaacggcagcagcagcgtggccaagctcgtgaatcaaaataatgatcattaaacaaaacagcgctttaatatgtcctgtcatgataccgatcgccatgacaagccacagcagcggatgaatgtgaagcttggtgaagagctccgtccatttactcaaatgtgatcacctgtatcggatcaacaaattcctctccttgtttgatcgcaaagtaatagatgcctttttgatttttatcctgctcaatcgttccgagcttcgttcctttatctatataatcgtataaagcgacatccgcttttttcagctggccgtagtaggtatagctgttgtccgcatgctgcaagaccaccgtcaggcctgtttccggatttttgtccacttcaatgacatagccttccttcatgctgcggatcgtttcgtcttctgtttctaccttaatgccctgccctgagaatttctcctgaacctttcctacggcaggtacagcgagatcctgattcacctcgacctggccggacggtttggcgcctttcggctgaaagaatgcgaggggatcgccgaacttggattcataccaattctggagggccgcaaattggaactcttcagtaaacacctggctgataaccggtttgatttggtttgcgggttcaaactggcctttgtaggcaatggcggacacaagaacaaggcatgccgacagaagacatttcaagatgagcgcatccgccttgacaagcgggtgcttcccgtttatcagcagggaacttccttcaggcggagggaagtctcctcctttttcatcttccgaaaaggctgtccatgcaggcggcttgagcggccgctttttgccgtctgatgaaaagggctgtttgtccggtgttttccgctttcttttcctggccattctttttcgaatcccatctgctctatgactcataaccctcatcctttacattcaggttcgtttgttcaatgatatgccttgtcccagggaattatgacggaacattgacataaaactaaaaggtttcatataatagaaaggaaaccatttggttttacttttttctaggaggtctattatgagcaatcaactagtgcctgatatacataaacaggctgtttttcacgcatcgatagaaaaagtgtgggaggccgtcgccaccagtgaaggcatcgccgcctggtttatgcctaatgatttccgcccggagatcggctgcgaattcaccctgcagtctcctttcggcccctccccgtgcaaagtgatcgagcttgatgcgccgcatcgactcgctttcagctgggatacgtcgggatggatcgtcacatttgaattgaaagagctttctgcagaaaaaaccgaatttaccctgattcattcaggatggggtgcgccggaagaaacggtttcaaaagcgggagaaaagcaagcggatgtccgcaatcggatgaatggcggctgggaaacaatcgtcaatcaaaagctgcgtcaggcagttgagggctagtgacatccgccgcaaaacatgatgtgttccaagccgtttccgatccctcccggcgaaaaatgctggagctcctcgccggcaaagaattgcctgtcacagatatcagcagccatttcccgatgagccggacggctgtttcaaagcatctcagagttttgtccgaagcaggcctagtcagcgggagaaaagcgggcagagaaaaactgtacaggcttcatcccgaacctctcgccgagctgcagcagtggctcgcctacttcgacatgtattgggacaataagctttccttgctaaagcataaagtagaaaacgatcaataaaactgcaaaaaaagcaatctcgctttggagattgctttttgcagttaagcgcgtacgccgaaaaatgatttaatctttgcgaaaacgcctttattttcttcttcaaacgactgtaaaggcacagattcgcccagcacgcggcgggcgatgttccggtatgcgattgaagctttattattcgggtccatgacgacaggctccccgttattggaagctttaatcacttcatcatcatccgcaacaataccgatcagttcgatcgacaagtgctgaatgacttcatcaacatccagcgtatcgccgtttttcattaagtggttgcggatccggttgacgacaagtctcggcggctcaatattttcttccttttcaagcaggccgatgatccggtcagcgtcacgaacagcggagatttccggtgttgtcacgacaatcgccttgtctgcgcccgagaccgcatttttataaccttgctcaatccctgcagggcagtcaatgacaatgtagtcgaagtcttgtttgagctgctggatcagcttgaccatctgctcgggcaaaacagccgacttatcgcttgtctgagcggccggcagcaaataaagcaaatcatcaaagcgcttatctttcacaagcgcctgatggattttgcatcgttcctcaacgacatccaccaaatcatatatgattctattttcaaggcccatgacaacatcaagattgcgcaggccgatatccgtgtcaacgagacatacccgtttccccaaaatggccaaggcggtgccaagatttgcggacgtcgtcgttttgcctactccgcctttccccgaggttattacgatagcttcacccaattttacattcctccctcaagccttgttaaactaggtcttaaatgagctaattgctgaaggcggtcaatgaccatattctcattttcatctaaataagcacattccatgtcgttcccttcttggatgttgtctggggagcgattgagcacatgattgatacgcaattgagtcggtctcatatccgaagccgcaataacagctcgtttatttccattaaaaccggcgtgggcaatccctcttaatgagccgaggatgaaaatattccctccggctttcaccattcctcccggattcacatccccaatgagaagcaaatcaccctccgtttcaaggacttgcccggaacggacaatcttagcgacagaaataatttcgctttccgcttttaagcggtttgcttcatctttggtcatgacttcactttcaatggagtggatgaacagattttgtttctcagtgatcacatcggtcaggatctgttcttgctcctcggtcacatagcggtggccgagcttaacgagaacattgattttctggccttttccatccatataatgttcgagtgacagcatatcctgaagaccgtacaataattcttcaaaagagcatgtgtcatcaagatgaagcgtcaatccatttttcgttcctttaattgttacgtattgctgcttttgggtcttcacggtgttcacctcaacatcatactcttttcgacatcggctcataaaatcctctttttactcattcctcagctctttcttaagactggtaaaaaaccatttgaacgggtaaatgagcagaaggccgccaacggcgttcagcgcaagcgtgggcaggagcctgccgagcacaaattgatggaacggcataatttccggacgtatcagcatctgcacgccatattggtaaaattcaagaacacagacggcgagcagcgaaataaaaatgacgaccagcgcgtttgtctgcaatactttgaacgcttttgacgataaatagcaaataccggcaaaaccaaacatatatacacctaaaaggtcggtgtaattaatatcatataacagtccgaaaataaatccatatgtaatggcaaaaggctgattgacataagccgtcataaaaactaagacaagcagcagaaaacgcgggatgagctgctgttcttccgtcacaaaaggcaagttgacaaaatccgcatagacgctgtcagatactaaaacaaacatcatgacgacgggaagaaggaagcgtttcacgacccttcctcctcatcgtccatcttgtcgacatccaccgtatcaagcgttctgtcgacgacgatgacgttatcaaggttatacatatcggctgccggctctacataagcgattttcgtcaaaccgtaggaatctggttcaacctctgtcacttttccgattgtcaggcctttaggaaaaacgccgcccgcaccggaagtttcgacgaggtcaccttttttcacttccctgtcttcatcaggctcgatgatttccatggaaagcgcctttttatctgagtcgtagccgttgatgattccgttcaccgttttcttgcctttatctgcagcgataactgtggagattctgttgtttctgtctgttgcgcttaaaagctggacggtggaagtgaaattgttcacttttgtgcttttgatttttccgatcaagttgccgttttcatctgttaccgccatatccttctcaacgccgtgctttgaacctttgttgatcgtaatcaggttccaccactcatacttatcgggatttctggcgataacggtcgccagaatcggcgtgtagtctttaattgatttcagatggccgagctcttttcttaaagacttattttcattttcaagctcctgcagctttgcctcgtattgtgtctggccgtcgagctttttccgcaggcgctcattttcgctgtacgtattttttaagtcttcgatattttcaaagaagcccgcaaaaaattgagcgggcgtatgaaaaatcgtctggaatacaccagttgtatcgccaataaatttttcgggccaagttgcattccggtcattctttaacgaaaatccaatcattgccactaaaatgatgatacaaaggagtaaaagcatcaaccgtttatttgtaaaaaactgcggcatgattatacacctcttctattccctgtgtccttaatttttgcctttaaatagatgaatttgctcgagagctttgcctgttccgatcgctacacagtcaagagggtcttccgcaattaaaaccggcattttcgtttcttcgctgatgactttgtccaggtggcgcagcagtgcgccgcctcccgtaaggacgattccgcggtccataatatcagccgcgagttcaggcggagttttttcaagcgtattttttacggcatcgacaatggcggtcacagtgtcgcgaagagccgctgtaatttctttttcagtgatttcaatcgttttcggcaggcctgttaaaagatcgcggccgcggatctccatgctttctccgttttcagaagcttcggcagaaccgatttcaagtttgatcgcttctgcagtccggtcaccgatcatcaagttatatgtttttctaatataagtaatgattgcttcatccatttcatctccggcaacgcggatagactgggatgtgacgatgccgccgagggaaataatcgcgacttcggtcgttccgcctccgatgtcgaccaccatgcttccagtcggctcccaaacaggaaggtttgcaccgatcgccgctgcaaacggttcttcaatcggatatgcatctctcgctccggcctggcgcgtggcgtcgataaccgcacgctgctcgacggccgtaattcccgacgggacacagaccatgacatacggctttctcgcaaataagcctttgtttttaactgctttgctaatataatgcttcatcattgtcgctgttgtttcataatcagcgattacgccatccttcatcgggcggagggcaacgacattgccgggcgtacgtccgatcatgtttttcgcatcatttccgactgcgacaatctgctttgtgtctgtttgcagtgcaacgacagaaggctccctgacgacaattcctttacctttcacaaaaacaagcgtattcgccgttcctaaatctattccaaggtctctcgcaccaattccaaacatttgtatgtatcttcctttcttaaaacaatattcctaagcaaaaacccataaattctattatagcttaatttaatgaaaaaaaaagtgttacaaatatcctttttcttttaagctcacaaatttttgatcaccgatgatgatatgatcgagcaattcgattccgagcagctgtccggactcgtgaaggcgctgtgtaacttctatgtcttcgcggcttggagccggatctccggacggatgattgtggacgcagatgaatgaagctgcggagcgctttaaagcttctttaaacacttccctcggatggacgattgaagagttcaggctccctataaaaaccgtgcgcttgtggatcacctggtttttcgtgttcagatacacacatacgaagtgctcctgagagagaaagcgcatatcccccattaaaaaattggccgcatcttcgggaaaacgaatcacataacggtctttgcaagccagactgtgaatgcgccggccaagctcaagggccgccaaaatctgcacggcttttgcgcggccgatcccggaaatgcttgaaagctcctcggcggatgcttcttttaacaaacggaggccgtcaaacgtttgaagcagccggcttgaaagctgaagaaccgattcttttttcgtaccggttctgagcagtatcgcaagcagttcatggtttgacaaactttcggcgcctgtgttgagaaggcgctcccttggcctttcttcatcaggaaaatcttttaatttcaatggcagatcgcttatgataaaccctcccttttgattcccttctcgttcggtacatcaaaaggagtggagatcaaacgttttcagcattctcatcgttttggaaatcggaaggcccacaactgtataatagtctccttttatctgtttgacaaaaagcgcgccttttccttgtattccgtatgaaccggctttatcaaacggttctcccgtagcgatgtaagcgctgatttccttttcttcaagaggccaaaaagagacttcggtttcctcaaaaaatgtttcgcatctttcgccgtccttaatgcagacgccggtgagcactgaatgggtctgtcccgaaagcatgctcagcatccgttctgcatcttcggcatctttgggcttgcccaaataagctccgtcataataaacaatggtgtcggcgccaagcacgacggcatcaggatattgttcggctactgcacgcactttttgttccgccaaccatttgacgttttctgctggtgaaaagtttcgaattaatttttcttccgcattgctcgtaacgatgctgtacggaatctgcaggagatcgaggagttcctttctgcggggtgattgtgaagccaatatgagctgtcgggtcataagaagccatcctttcaaaggtttttgcataggaaaaaaagatacctgttttatcctaccaaaagaacgccgccgccacaatttcagaaaaataactttttaatgacaaaaatcgcgaaaataaaaaaaccagcacgtctgctggttttctatttatttaatttggcccagcaatagctgctggctcttccagccgttggctgcggtcggtttctccagaaggttgacggcttccagtatgctcttctttacctcttcagatccttttgattgggccccgtcaagttgagctttgacatcggctatgttttgagatgtaacctccgcgccgagaatcgcttttgccgacagctcagccgcttctttaaaaggctccagcaaaccggactcgattgcaaccggaagctcttttccgccccacgcttcaaaatcgttttcgattaatattttgccaagttcagatgtcatctgcttttctcccgttattccggcgattacataaaacccgtcgtccttggcaatcgacacggcggcataccccttgtctgcgatttgagaggccagcgtatccgctccttctttagacgaaaactttccggcctgaacggcgaagctgttaaaagattctcccgcttgtccgctatttttttctccgctctttttctcctcggcaccggagtcaccggctttaacggtctggccgttttcagcatccgccccaagactgccggaagccggcactccttctttatgcgttgcgagattcagcgcaaacagaccaagtcccgtcccgagcaaaacagcaaagacgatggtcgcggcaaatcgcttcacaggatacgtaagagacgttttcgttttgcggttgtttttgggctcgtttttcttttgataaggcgccaccactttaggatcgtctttgtagacggtttcttcttcgtccggtggcgtccatgtaaattcacctgtttcatgtgtgccgtcctcttttgaagccgatatttcccgttctgcctttctcttttcttcccagttcgaaaaggtaaacttcttttcttcatttctgttggaaaactctttttcatttccgtagatagtctcttctctgccgttgatcatcactttaagcgggtcttgttcgggcgcttttttagctgagtttttcttgcttttccgttttttcatatgcttccctcgctttctgttaattgttttatattgatttaggcggcagcttggccgctctctatacgctcggcagagggaagccagaaggaaggaggagttctcctaaaggctgtccctcttaatgtccacactttatcacagcctcaaaaaaaaagaacaagacttttgtcgtcttgcccaaaaaggtttcgtcaaatttttcaccaccatgccgtttgaaggtaccactcgatcattggttcgccatagaagcagctcgtcagcgtcccggccagaatcgcgggagcaaacggcattggttcatttttcttcagtttgcctgccaggagtgcaataagaccaagcaccgttcctgcggctgccgagaggaaaaaagcgagaacgaggaggcggctgccgagcgccatgccgattaccgcaaacagctttacgtctccccagccgatcccccctttcgtcaaaagcagcgtcaagaggggcagcataccgccggccatcgcaccgctcaaacttgagtgccactgttccagaggaacaaggaatcgtccgacggcaaagacaggcaggaaaaaacaaagaacagcatccggaatgatcatgtgtgtcacatcagatacaaagacgatcaaaagcagagatataagagcaagcacaatcaccagctccccctcatgcccaacgtgcatgccggcaaacgcaaacaggatggcggcggagagctcaactgccggatacacgatcgagagcggggtttgacatcctttgcacctcccccgctgcatcaaataggacaaaaccggtatcagctccgagaagcccagctgccttttgcagacgcggcagagggaacgcggagcaatcaatgatatcttttcagaaatgcggcgcccggccgaattaaaaaaagagccgagcactaaacctgccgtaaaaaggtaaaagatgaacatcgttatcaacctcgcagaatcaaatttcatgaaaaaagctgctgcctagcggctgttattttagcaaatatgaagcgcctccgcttttcctaaaacataaaaatgcgccgtcagccggtggccaaaagcgcatttttatgttttattcagttaaagctgccctgacggcggaaataaaataaagcgacccggtgataacgaccaccgctttttcctcttcagctttttcttcgatataccggaaaacagaggcgatgtcttcatcaaatgttttataatcagcggtactttgctcaaacagcttttgagcggattccgccctcgggaaatcaaaggatgtgaagtgaatcgatgacgcaaacgactcgattttgcggatcatgtctctgtacggcttatctttaagagcgctgaagcatacgtgaatattccgcccggcgaagtgggaggagatcgtctcggccagccgctccatcccttctttgttatgagcgccgtcgatataaacaagaggcttgttcaataccttctcaaaccggccgggccatcccgcgttacgaatgccgcgtttcagctctttttcgccgatcgccgcatgtttttcggctgtcagccattcggccgcaagtatggccaaagacgcgttttgccgctgatgggtgccgatcaggcttgtttcaattccttcataatgatgtaacggtgttttcaacgaaaactgctctccctcaggcaatgaaagctccccgtacagctggcaatcctcgtgaagggatataaaagcagattctgtctccatcgcctttcgctttatcacctcagccgcttcatgctgatgaacggctgtgataacaggaacgccgcgtttgatgatccctgccttttccgcggcaatctctttcaatgtaccgcctaatatcgccgtatggtcatggccgatcgaagtgatgaccgttaacatcggcttcacgacgtttgtcgaatccaaacggccgcctaagcccgtttcaaaaataacaaaatctgtccgcctgtatttagcaaaatataaaaatgcgcatgccgtaataatttcaaattctgtggcggctccgaattcggttttttcaagctcaaggacaagaggcccgacctcattaaagagcgccgtccattcttcatctgagatcggggcgccgtcaacgctgatccgttcgttaaaggtgatgatatacggtgatgtgaaggtgcctgctgtataaccggcttcatttaataccgaacggagaaaagcgatcgttgaaccttttccgtttgttccggcgacatgaaccgcattgagctttttctcggggtgcccgagctttctcagcagccattccattcgttccaaacccggcttcacgccgaatttaagccttccgttaatccagctgagtgcttcatcaaacgttttgaacaagcgcattccttcccttcaattgatgaaggtgttttccagcagctttagaaagacctggaaaacacctcctttttcgtgttatcagtttttcaattcggcgattcttttttctacagcttcacgcttcgccgtataatcggcttctttcgcccgctcttcttcaatgacatgtgcaggtgcttttttcataaatccttcattgcttaatttcttctgaacccgttcaacttccttcgtcagcttatcgagttctttttgaaggcggctgatttcttcgtcaatgttaatcagaccttcgagcggcaagatcagctcggcgccagatacgacagcggtcatcgctttatcgaccgcttgaatatccgttccgatctgaagaaggctcggattcgtaaagcgttctacgtacaaacggttttcttcaagtcgttcagcgatttccggcgtgctcgttttaatataaagttcaatctgcttgctgagcggcgtgttaacttcgctgcggatgttccgtacggcgcggatgacttcaacgagaagcttcatatccgccgcggcctcggtgtccgtatattctttgacggcctcaggccatttggcgactgtaatggattccccttcgtgaggaagatgctgccaaatctcttccgtcaggaacggcataaacggatgcaggaggcgcatcgtttgatccagcacatacgctaaaatggagcgggttgtcttcttcgccgcttcatcttcgccgtaaagcggaagtttagccatttcgatgtaccagtcacagaaatcatcccagataaaattgtagagatggcggccaacctcgccgaattcgtacttgtcggccagctgtgtcacggtttcaatcgtttcattcaaccttgttaaaatccacttatcggcaacggatttttcccctgacaggtcaagctcttcgtatgtcatgccgtccatgttcatcagagcgaaccttgatgcgttccaaatcttgttcgcaaaattccatgttgactctactttttcaaagctgaagcgtaaatcctgacccggagagcttcctgttgcaaggaagtagcgcagcgaatccgctccgtacttgtcgattacatccatcggatcgacgccgtttccgagcgatttgctcattttgcggccctggtcgtcgcggatgagcccgtggatcaagacatctttaaacggacgttctccggtaaattcgataccttggaagatcattctcgatacccagaagaaaataatatcgtagcctgtgacaaggacgttcgtcggatagtagcgcttgaaatcttcctcatcgatatcaggccagcccatcgttgaaaacggccaaagagcggaactgaaccatgtatcaagaacgtctttgtcctgctcccagttttctgcatcttccggcgcttcaacgccgacatagatttcaccggtttctttatggtaccatgccggaatccgatggccccaccagagctggcgggaaatgcaccagtcgcggatattttccatccagtgcagatacgttttttcaaaacggtcagggacgaagttgactttgccttcgcttttttgcaattcgatggcggcgtcggcaagcggctgcatttgcacgaaccactgtgttgacaaatacggctcaacgactgctccgcttcgttcgctgtggccgaccgaatgcgtatgttcttcaatcttgaacagcacgccctcttcctgaagatctttcacgatctgcttgcggcattcaaaacggtccatgcctttatattgaagggcattgtcattcatcgtgccgtcttcattcatgacgagaatgcgttcaaggttgtggcggtttccgatttcaaagtcgttcggatcatgggcaggcgtaattttgacggcgcctgaaccgaattccatatcgacatagtcgtctccgacaatcgggatttctctgcccgtgatcggcagaatgaccgtttttccgattaggtgtttgtaccgctcgtcttccggatgcaccgcaaccgctgtatcgccgagcattgtttccggacgggtcgtcgcaatttcaatcgagcctgaaccgtctttcagcggatatcgcatatgatagaacgcaccttgtacgtctttatagatgacttcgatgtctgacaaagccgttttggttgccggatcccagttaatgatatattctccgcggtaaatcagccctttttcataaagctttacaaatacttcgcgcaccgctttagaaagcccctcatcgagggtgaaccgctccctagaataatcgaggccgagaccgagctttgcccactggctgcgaataaaatcggcatattcctctttccaattccatgtttcttcaaggaatttttcgcgtccgagatcatagcgcgtttttccttcttcacgaagcttcgcttctacttttgcctgggttgcaataccggcgtggtccatacccggcagccagagcacgtcatagccctgcatccgtttcattcttgtcacgatatcctgcaaggtggaatcccaagcatgccccaagtgcagcttacccgtcacattcggcgggggaatgacaacggtgtacggttctttttctggatcgtttttcgcttcgaaaaatttgccgttcacccaatagtcgtatcggtctttttcaactgcagacggatcgtattttgtcggcatcgtcagttcttgattatccattttcaaacctccaacagtattaaacggctgaacaataaaaaagagtcctcttgatcctgttaaaaggacgaagagaactctctcgcggtaccaccttttttcatgaatgcaaaaaaaacgcattcacgcacttaaatgggataacgggactttcccgaatttctctacttttttgttcgagaaattgcgctcctgggcgaccttccaaaaaagactgactgggagcctttcagcgaaccggcttccctctctgcaagcgtctgtttttgtactcttcccattcaaagcgggtgatcattgacttttcagcacgtactttttctttttcttatattactaaatctttttcattttcgtcaatcatcttttccgtttttctgttgttttatacgagattgggccatgcacacaagctccttttcctcatatgatgctgtaacgaaaaggagaggaggcataagatgcgaaaaaaattcaacacatattcattccagccgtggctgaagcaagtcaggcttgttgctgttcaagtcgtcctcccgattacgatattccagggcatccgcacgatcatctttcctaccacatttgatgtcctccttttgggcattctcatattccttgcgtgcgcctttcaccttgactggatttaagcacgaaaaaaagtccgcatcatgatgatggggactctgtttcttcctgcagttttctgttttcttccgtctcgtgaatgctcatcacaagcggctcagcgtttttcatttgccagtacgcctttaaaagccttgtacaggcttctttttccccgagccccttctcatgttcgtagcggttcagtacgccgaatacaggccccgggtaagccatatagctgaggaataagctgatttcttcctcccgcaaaggatagacattgtgatacgtataaaaccagtttacacattccgtgcacataacggggttcgtcttaaacattctagtaaaaaatacgatgagatcatttgcaggcggcgcatgtcccgctttctcaaagttcgtaaagtaacccgttccggtatcgttatagagaaaatgccgaacggacaggtgcccgtggtttaagaccattctggcagactctttttctctcatggcttcatgccaatcttcaaggcgggcgagcgcaaagtcggcagccgatatcgtctctttgaaatacatggccgcctgaagctggaacggggacatataccattcgttttccgctttcatgatgaatgcttcatatttctgtttttgctgttcccatttccgttttgtccgttcatagtgtccgagtatttcttcccgcctcacgccgagctctttttccgtccgctggtgaagaagagcgatttctttaaacatatattcgtgtttttgatcccgctcttcctccctttcaagagtaagccagggcatgagatagcagacatcttctccggcttgcgttaaaaattcgcctgtgcggtttcgatagacaggaacgaactgcctgtagcctttttcctccagcatgatcatctgttccgtgaagcgggtgtttcttgaagccgccaattttttcagagcaaatacaccgtgatccgtatacactttccacacctttgaactgacggactccatatattcaggcgtaagaccgtactcatttaaaacagactggatgccttccatcggcttcaccacatttttatcaatgcattaggcatggctgttttgataatccggtatataaaggatctgtccctcttttaattcctcgtcaagggaaagggaattcatccggatgagctgctggacgttaatatcatagcgctcgcacagaagatcaatcgtatcattttgctgaacgatgcacatcctcattcgagtaaactcctcctctccctgctttgtaaacagctttgtcaaatagagtgcgttgtcgttttcctttgctgacacttcctgttcatccgctgcctgcatttcatctctttcttcttcgggctccgtctgctcatgaaacgaatattccgggatttcaatcgtatgcccggcttcctcttcttcatcaatcgcttctgcttcctgtgtcacctcaacctcaaaagcctcaggctccctgtcattctggtcttccttcagaagaggaggaacactgtagaacgggttctctttcagttcctcgtgaggttgataagagctgtgcgacagctccggctcttcttccgcttcttctcttttcagctcatattcttccggttcctcttccactttctctcttttcagcttatattcttccggttcctcttccactttctctcttttcagctcatattcttccggttcctcttccactttctctcttttcagctcatattcttccggttcctcttccactttctctcttttcagcttatattcttcttccggctgttcaagagaggcttctttttgattttctatttcgcgcttcgtacgctctgccgccgacaaagacgctgtaaaaaacggtttagcttcctctgtgtcgtttccgagaaacgactggtaaatcggaaccgtttcctcaccggtatcatgttcttccgcctgttcttcgtcctgctcttcgtaaggtctgtcaagctggatcaaatattctttctcttcaccctgatcttcgtcgtttgaaggtgatctgtaggcaggttcgagctcctcttccggatggacggccgcaggcatagtgcgcggttcttcttcacccgcttcaccgctcacattcaagaggccttcaatcgccaaatcagcctgaatcgtcagcatcctcgcatctgtcagctgataatcgaaagcgtcaataaaaacaaatacgtcgtttaaatgattgactttgtctttcgggatggtgatatccactgggaaacaatgcgtcagctctgcgctgccgtcccctttcagctttacatcttctacaaatcggcttgtcgcaggcagctctgcatactcccgggtttgatctatgttgtattcgcctgtcagctctaatgaccctcgtatggatacataatcatttacttcctgaacagtaatgtcaggatccaatgaaatcgataataattcggatacttcctgtcctttttgaaaacagattgactcttctacagaaaattgcaaacgattgttttgcggcaaactgatatcctcccttcacctaatttttaaaattagatgtcagtaaagatgtatgtgaaaagcaggcagaatatgaacagaaaaatcagcagccgttttcggcaccatgcaaaaaagagccgccggcaatgtccggcagcccttttctttatctggagcggctgattctttcgaatacgcgttcagcagctttaatcgtatgctcaatgtcgtcatccgtatgagcggttgacaagaacagcccttcaaactgtgaaggcggcagaaacacgccttcatcggccattcctttataatattcggcaaacagtccgaggtcagactgtttcgctgtatcataattgatgaccggtccatttgtgaagaaaaagccgatcatagaccccgccctgttgaatgtacacggaatgccatttttctctgcagcttcagaaattcctttttccaagcggtcagctttgcgggagaattcccggtaggattcaggggtcagctgtttcaacgtttcaagtccggctgtcatggcaagcgggttgccggacagcgtcccggcctgatagatcggaccgctcggcgcgatcttctccatgatttccgcctttcctccataagcgccgacaggaagaccgccgccgatcacttttccgaggcatgtcaaatcaggcgtcaccccgaaatagccttgggcacagttgtaatccaccctgaatcctgtcatcacttcatcaaatatcagcagggcgccatgcgtctcagtcagctcgcgaagcccttcgaggaaccctttaaccggcggtacgacgcccatattgccagcgacaggttcaacgatgacgcctgcaatgtcatctccgaattcttgaaagacaagtttcatgctttccagatcattgtaaggaacggtaatcgtgttttttgcaatgctttccggaactccggggctgtcagggaggccgagtgtcgctactcccgagcccgctttaatcagcagggaatcaccgtgtccatggtagcagccttcaaattttacgattttgttacggcctgtgtatccgcgcgccagccgcaaggcgctcatcgtcgcctccgtaccggagctcaccatccggacgatttctatggaaggaacgcggtcgatgacaagctcggcaagctcggtttccagttctgtcggcgcaccgaagcttgtcccgtgttctgccgccttttgaatctctttcaccactttttcattgctgtggcccaaaataagcggtccccatgacaggacataatcgatgtattcgtttccgtcaatatcatagatttttgatccttttccccgctccataaaaatcgggtccatgttgactgatttaaaggctctgaccgggctgttcaccccgcccggcatgactcgttgcgcctcttcgaatgccgctttagacttctcatagctccgcatcctctaaaacccccagttcaaattcttattccgaaatccattttgccgcgtcttttgcaaagtacgtaatgatcaaatcggcgccagcccgcttcatgcttgtcagcatttcgagaacaagagctttttcttcaatccatccgttttgggcggcggctttgaccatagcatactccccgctcacattgtatccgacaacaggcaggttaaattcgttcttcacttctctgacgatatcaagatatgaaagcgtcggcttgacgatcagaaaatcggcgccttcttccacatcggattttgcctcccggagagcttccctgcggttggcataatccatttggtacgtcttgcggtcgccaaactgcggactgcttcccgcagcatcgcggaacggtccgtaaaaagcgctcgcatattttacagcgtacgacatgatcggcacatttgtaaatccttcctgatcaagcgcttccctgatagcggcaacgaaaccgtccatcatgtttgacggcgcaataatgtcagcgcctgcacgggcttggctgacagcggtttttgccaaaagaacaagcgattcgtcatttaaaatttcaccgttttccaccaggccgcagtgaccgtggtccgtgtactcgcataggcacgtatcggcgataacgacaagttcaggaaagtcctgtttaatttgtgcaatcgctttttggacgatgccgtgatcgtgataggctccgcttcccacatcatctttgtgctcaggcacgccgaagacgatcacagattgaatgccgaggcttgcgacttcctccatctcatctttcaaacggtccaaagacagctggtacacgcccggcatagaaggaacttcgcttttgacgttctcttcctcggtaacaaatatcggataaatgaaatcagatgctcttaactcggtttcccttactaatttccgcatacctgctgtcgtccgcaggcggcggtgtctttgaaatgatgcttccattagtcattctccctttcttgaaatgcggcacatttcgcgcagcattccgtcgattgtatagacgtccggcatatatgatggaattccgtagtccgacagcgccttctttgtcaaaggcccgatcgtaataaaagccgtccggttcttttcggcccacgctaagctctcctctttcagaatggacatgaatgtatgtaccgtcgaagaactggtaaacgtcacaaaatcaaaagacgcgtgctttgctgcttccttcaggtccagaattcccctttcatcacgcacggtttcatacaaaatccattccgaaacttgaattccgagaggagagagggttttcttgatgacgtcccgggataaattcccttttaaaacgaccactttgtcatgacgtccggcattttgcttaagtgcctccgccaaatgttcagccacgtataactccggcatcagatcgacagaaagacccctgtcgcgcaaataccgggctgttttttcaccgactgcagcaaccttcgcctcggacgcgagaggagcactggccccggcgtcctttaaataagaaaaaaagaattttgccccgttcacgcttgtaaaaacaagccagtccgcgctttcaagatccgcttgaaagcgctgggccgcctctggcggaagggcgggccgaaacgaaatcaatgacgttaaaacagcttctccgcccaaagcctccaccttttccctaaaggattgggcttgcgctttattgcgggtgacgagcactttctttccctgtagaggaagatcatgcttcatgatcttccagctcctgtttcacccggtcaatcagtgccttcgctcctttttccgacatgaccgccgcgcattctctgccgacagcccccggatcttttccttttacggtttctctgtatacggtttttccgtcaggcgatgccaccagaccggtcagttcgatgacgccgtcttcgtccatctttgcaaatcctgcgatcggcacttggcagccgccttccatcgcatgaagaaaagcgcgctcagccgtgacggtcagctgtgtgtagcggtcgttcaggcgcgaaaagagagacagcagctcctcatcagagcctctgcactcgatcgccaaagcgccttgcccaacggcgggaaggcagctttccggatcaagaaattcagtgacgacatcgtccttccaccccattcttgacaggccggccgcagctaaaataatcgcgtcgtaatcttcggtttcaagttttttcagccttgtatcgatatttcccctgatccacttgatctcaaggtcggggcgcatttgcaaaagctgtgcgcttcttctgaggctgctcgttccgacaactgcgccttgtttcaagtcagccagcttttgacggccttttgaaatgagaacgtccctggggtcttcccgttttggaatgcagccgaccatcagcccttcaggaagcgccgacggcatgtccttcatgctgtgaacggccatgtcaatctccccggaaagcatcgcctgttcgatttctttgacgaacaggcctttcccgccgacctttgacagcgtaacatccaaaatccggtcgccttttgtaacgatttcttttatttcaaacgtgaaatccggatttaattcctccagctttttgatcacccattttgtctgggtcatcgccaatttgcttcttcttgagcctacaatgatgtttctcatgttttcttcctcccaatccgtcacgggcaaccgttttaactaactaaaccaatgaaactgcgaaaagctgccgagcaaaaagaaattgattaaaagaacaagaaaagacgcggcattccacatggccgcgatccttccctgcagctctttgacaatcctgataaataaatagtatccgtataaaaaaagcagcacgatcgatccaagcactttcggatccgcccagtacagggtttcaagcgatacatacgaccagataatccccagaatcaggctcagcagaagcatgggaacgccgatgagattgaggacatacgccatatgatcaagttttgacaaatcttctattctcaaaagccatttcccccactttttctttttcaataagcggtactgaaaaagatacagcacggaaaagacaaaggacaatgaaaatgccccgtacgaaagaatcgccatcgtaatgtggatgatcaaaagctcggacacgagcctgcccgaaagctccgccgactgctgggccgtcggagtaaacgtgtggatcgccgccattgaaaagccgatgagattggtgaaaaaaacgagaaaatccaccttcaagagtttcgtcaaaacgagagacagcgtcacgagcacccacgcgtaaaaataaagcccctgcgcattattcaaaacaggaaactgatctgtgtactgcatgaaataaaaaaggtaaaccgtctggagaatccagacaatagaaagcaaccagaaggccgcttttcccgccttccggttgtgctgtaaaaagtctataaaataaaagagaacggtgaacgcgtacaacacgattgtaacttcgttaagccttgctaacaatgtgtctgtcatgtctgtcactcgctcgcgatagaagtcaaaccctgcggattttgccgcttaaacgcatgaaccggctgacgttcgtcctgcttctccccgtcgggaaaagccgcttcttcaatatcaaaaatctgcgtgaacagtgcaagcttttcttcggcatcagcttctgacgcaaactccttcacttttaaaatcgggtcgcgcaaaagctggttgataatgcttttcgtatgcttgtttaaaagttttttctcccttgtgctcaaatgagggagcttccgttcgatgctctgcatcgtttccgcctggatcgtcaaggctttttccctgagagccgagatgaccggcacgacgccgagcgtattcagccattgtttaaaagaaacgatctcagcttcaataatcagctccacctcttcggcaacggcctggcgttccttcaaattttcttcgacgatcccttcaagatcgtcaatatcgtacaggaagacgccttccacttcgctgagagccgggtcaagatcccgcggcacggcaatgtccaccataaaaagcggacagcctttgcgaagcttattgacatgttcgatcatctcttttgtgacgacatagccgctggcgccggtcgaactgatgagaatatcggcttccatcaaagcgcattgcagctcattcaagcttttcgccgcgcctgaaaaacggccggcaagctccttcgcttttgaaaatgttctgttgatcaccgtaacctgtccgattccgtggccgtgcaggttttgaaccgcaagctcacccattttgcccgccccgagaatcagcacgtgtttatcggaaaggtcgccgaagattttcctggcaagctcgacggcggcatagctgacggatacagcatttgaagcaatgtccgtttcggcatggcagcgctttgcgaccgtgaccgcctgcttaaacaaatagttgaaaacggtaccaattgtcttctcttcctgagccagcttaaaacttgtacgcacttggcccaaaatctgcgtttctccaataaccatcgaatccaatccgcacgatacgcggaacaggtgttcaacggccccgtcgttttcataaaacttcaagtaaggcgaaacgtcctctttgcttaatccgaaccagctcgccaaaaacattttcatataataacgtccggtgtgcagctgatcaacgactgcatacagctctgtccggttgcatgtcgacacgatgatgttctcaagtatgcttttttcttctttcaattgcgacatcgcctgccccagctcatccggctgaaaggttaacttttcacgtatatcaacaggggctgatttgtaatccaatcccacgacaagtatatgcataactcttgcttgcacccccaacatctatctaaattagaatgattataatatagaatttattattcaaaacgattataacatatattcactattttctcttcccaaaatgtgaacagattttaaaaaattgatgtgatatagtagaaaatgtgtttctatttctttcactacatcaagaaggtgatactttgaaaaagaaatctgttttgcttccattgctgttgatagccgttgctgtctacgcctttttgcggtcgggccggatcagcctgtttgacggccaggaagaatggtctgtacttgcaggtctcgtcggactggctcttttttatcagggacagaaggaagccgattccgcccattcctttgcagggctcttaatgacagcgatcggcgtttatttcacatttaaagaggactatttcagccgcgcggatgattttgcggtcatcgtgctgatcttcggtgcggcgctgcttgtcaaatcgtttaagacaaaagaatatcaatatgaaagtctgctgatgatcgcggtcgccctctatctttactttttccggcaaattgccgcctggctgaagtcggtgaatatcgagacggcatatgtagaagcttattggccggccgcttttatcgcggttagtctgctcttattattcttaaaaagaaaatagtttattcaagaaaaagcacttgcatcaatcccgcaagtgctttttctttatctcgcgatcatttgctcgatcgccgaccatgcttcttgtttaccctttttcgtttcggaggaaaacaatatgagccggtcttctttttctatattaagcgtctctttgacgactttggcatgcttttcccatttgcctttagggattttatccgcttttgtcgcaatcacgatcacaggaatttcataatgctttaaaaagtcgtacatcatcacatcatcctgtgaaggagcatgcctgaggtcgacgatttgaacgaccgctttcagttcttcgcgggatgtcaaatacgtctctatcatacggccccaagcctcgcgctccgttttggagacttttgcaaatccgtagccgggcacatcgacaaagtgaaggacatcgttaatgatataaaagtttaatgtctgtgttttgcccggttttgaagatgtcctcgctaagtttttacggttgatcattgtattgatgaatgacgattttccgacattagatctccctgcaagggcgatttccggcagtcccccttcagggtactgctcgggtttcaccgcactgatgacaatctctgatttcgttactttcatttctcttctcctactagcgcatgctttagaacttcgtccaggtgagcgacgggaatgaaggtcaagccttcccgcacgctgtttggaatgtcctcaatgtctttttcattatctttcggcataatgacagtctttaagccggcacggtgtgcgccgagcgccttttccttcaagccgccgatcggaagaacgcggcctcttaacgtgatttcgccggtcatgccgacatttcgcgaaacaggtcggcccgtcagcgccgagacaagagccgtcgccattgtgatccccgcggatgggccgtccttcggaacggctccttccggcacgtgaatgtgaatatcgtgtttttcgtgaaaatcagggctgatgttcaactcttccgcctttgaacggacatagctgaatgcggcctgcgccgactctctcatgacatcgccgagctttccggtcaaaatgagcttgcctttcccgggggaaagagacacttcgatggacagcgtatcaccgccgaccgtcgtgtaggcaagacctgtgacaacgccgatctgatcgtcgagctcagcctgtccgtacctgaacattctttttcctaaatagtcttcaaggtttttgtctgtgaccgtaattctttttctttcccctgatacgatcagcttcgccgcttttctgcatatcgctgcgatttggcgttcaagatttctgacgccggcttccctcgtataatagcgaatgacggccaggacagcctgctcccgtatttgcagattggattttttcaaaccgtgttctttcagctgttttggaagcagatggtctttgacgatttcgaccttttccacttccgtatagccggcgatcgtgatgatctccatgcggtctctgagcgggccggggattgtggccaggttgttcgcggttgcgataaacaaaacctttgataagtcaaatgtctcttcaatataatggtcgctgaacgtatggttttgttcaggatcgagcacttccagcatcgctgaagcgggatctcccctgaaatccgacgccattttgtcaatctcgtccaaaaggaatacgggattgttcttgcctgcttttttcatcccctgaatgatgcggcccggcatggcgcctacatatgtgcggcggtgaccgcggatttcagattcatccctcacgccgccaagggaaatgcggacgaatttgcgtccgagcgatttggcgatcgatttcgccagagaggtttttccaacacccggagggccggccaagcataagatcggtccttttaacgagcgggtcagcttctggacagccaaatattcgagaacccgctccttcactttttcaaggccgtggtgttcttcatcgagaatttgactggcgagctttaaatccagcctgtcttctgttgcatcgttccatgggagagaaataagccattcgatataattgcggatgacagagctttcagctgagctggacggaattttttcgtaccggttcagctctttaagcgcggtttctttcacattgtcaggcattcctgcctgttcgattttttcggtcagcttttggacctcgcccgtttttccttctttatcgccaagttctttttggatggctttcatctgctcgcgcaggtaatactccttttgtgttctttccattgaacgcttgacgcgctgcccgatcttcttttcaatctcaaggacttctttttcattgtgaatcaggtcgattactttgttcaatctggctttgacatcgatcgtttccagcacttcctgcttgtctttcagcttgagcgggaggtgggaggcgacaatatcggccattcttcccggctcttcaatatctgtcacagcggcaaatgtttccgccgatatttttttcgaaatctttatgtattgatcgaagtggtcaagcaatgtgcgcatgagtgcttcatcttcaacatctttttcagtctcttcatcgattcgctcgatttttacagacgtatattcatctaagtcatggtactcaagaatgcgggcgcgctgcaacccctccaccaaaacgcggattgttccgttcggcagcttgagcatctgcttgattttcgtataggttccgaatgtaaaaatctcgtcttcatccggttcgtctatggatatgtccttttgcgttgccaaaaagatcatatggtcattcatcatcgcctgttcaagtgcctgaaccgacttttcacgcccgacgtcaaggtgcaaaaccatcgtcggatagacgagtaaacctcttaaagggaggagcgggatgtttcgtttcgtttcatctgccattttgactgacacctccgtaactttagtatgaaccattataatatactttttttattcctgtacaattgtaagcccggcgaaataaaaagggtctcctgtagtataccctttctttcagttctgaaaaaggaaaagatgtcctccgctaagaaaacatgccggctcccggcttcggagaaaccgccccgaaaaaaatccccatctgaaacgatggggatttaaacggattctcttttcatttgaacgccgtcgggcatttctgaaggagggttgaccaatacgaggtcgagtacttcctgcaaggttttgacgggaacgatatgtatgccttctatccgctttaaaatcgactgaacattttcgtgcggaataatgactgtttttgcccccgcatgcttggccgctttgattttcggaatcacgccgccgatcggctttacccggccgttcaggctgatttcacccgtcatggcgacagtatggtctatcggaatcttatgaatagcggagaatatgcccgccgccattgcaatccctgcagatggtccgtcaaccgggataccgccggggaaattcacgtgaatatcataatccgaagctttgactcccattgtccgcaatacagtcatgacgttttcgaccgatcctttcgccatgcttttccggcggatcgattttgactggttgccgatattctcttcttctgcaatgcctgtgatattaatcgatcctttatcagccgcctgattgactgtgacctcaatttcgagcagcgaaccgctgttaggcccgtggacggcaagtccgttgacgatgccgacctgcggtttagaggcgattttttgttcgtatttcggtgtcagctggctcgaatggatcacccattcgatatcttcaaccgtcacctcgtcgcgctcttcagtcaaagccattccggcggcgatttgcatcatattgacgacttcgcggccgtttctcgcataccgcgtcaacaggtcgagtccttcctctgcgactttcttttgaatcttatctgccgcttttttggcgaccgtttttaattcgtgcttttcaaggtcgcggaagaacacttccaaacatctcgaccgaatggcaggcgggatttcatcaggcatccttgtcgtcgcgccgatcagtctgaaatccgccggcagcccgttttgaaaaatgtcgtgaatatgcttggggatttgcgtgttttcttcactgtaataggcgctttccaaaaaaactttccgatcttcgagcaccttcagcattttattcatttgaatcggatgaagctctccgatttcatcgatgaataatactccaccgtgtgcatgcgtgacggctccctgctttggctggggaattccggcctgccccatcgctccggcgccctgataaatcggatcgtggaccgaaccgatcaacgggtcggcgattccccgctcgtcgaaacgggccgttgtcgcgtcaagctcgacaaaggcggaatgttcctggaacggtgagcgcttgttctttttcgcttcttcaaggacaagccttgcagctgccgtttttcccacacctggagggccgtaaataatgacatgctgcggattcggtccgcaaagggcggctttcagcgctttaatgccgtcctcctggccgacgatgtctttaaaagccgtcggcctcaccttttccgataaaggttctgataaatggattgatctcattttccggagctgttccatctcttttttggactctctgtctatcgtaaccttttgggttctttgatttttgagcaaattccaaaaatataatccgatgatgatcccgaaaaatagttgtacaaaaagtgcaatgctcgtccagctcaactgatggtccctcctgaaatggtttcgtatctttagtatgtcagatagtatttcctgatcagggagggaataaacgtacagaaagggattattttgcttttgaagccgtcactctgctccgggatgccgacggtttccggatgcaaaaaaagaacctcctttaggccaggaggttctctgcattatgctgaagtttttttgtctttattgacgaccgtgccgtctttcataatgagacgcggcggttcgccgtcagtgacggttttgcctgtgatcacgcatttttcaatatcctcgcgagacggcagatcaaacatcacgtcgagcatgattccttcgataatggaacgaagtccgcgtgctcctgttttacgttcaattgcttttttagcgatttctgtgagcgcttcgtcttcaaacacaagctccacatcatccaattcaagcatttttctatattgtttaacaagcgcgtttttcggttttgttaaaatttcaaccagcgctttttcatccagcggctcaaggcttgcgatgatcgggagacggccgatgaattcagggatcagcccgaagcgaagcaagtcttccggaagcactttggaaagaagcgcttctttttcaaggtcttcatgcttgttgtcagagccgaagccgatgaccttctggccgagacggcgcttgatgatctgctcgattccgtcaaaagctccgccgcaaatgaacaggatgttggttgtgtcaatttggatgaactcttgatgaggatgctttcttccgccttgtggaggaacgctggcaaccgtaccttcaagaattttaagcaatgcctgctgaacgccttcgcctgatacatcgcgtgtaatcgaagggttctcggactttctggccactttatcgatttcatcgatgtagataatgcctttttccgctttttcaacatcgtagtcagctgcctggatcagcttaagcaaaatgttctccacatcttcaccgacatagcctgcttcagtaagcgacgtggcatccgcaatggcgaacggcacattcaggatgcgggcaagcgtttgagcaagaagcgtttttccgcttccagtcggtccgatcatggaaatgttactttttgacagctcgacgtcgtcgactttgctgttcgaattgatccgcttgtaatgattgtagacggccacggcaagggatttttttgcctggtcctggccgatgacgtattcatcaagaatctcgcggatttcctttggcttcggaacatctttgaactccacttcttcttcagagccgagttcctcttctacaatttcagtgcaaagttcgatgcactcgtcacatatatatacgcctggtccggcgacaagcttgcgtacctgatcttgtgttttaccgcaaaacgagcatttcaattgtcctttttcctcgttgaatttaaacattctttcaccccttatatccttgtcattcctgtttcttcgttaaaagaaacatcgcttgaaaacattcgttccattatgtattgcattttaccacactttccaaaaaggcgataacgttgtgtttgccgtccggcatattcaatatgtatgttgatcaaaacgacattatctatcctttcccaaagaaaagatgataagtcaaaattgtataaaacaaggcacgaaacattcgcgccctgttttatataaagtatgattatgaaacatattaacggttttctacaagaaaatcaattgctttgcgaacttttaagtcctctttcattccgtctgtagaaccgattgcttgtttgatgttttcaacaggcatgttgtatgcttcagccattttagaaagctcttcttcgacttcttcgtcagtgacttgaaggttttccgctttggcgatcgcttccagtgtcaggttggatttcacgcgtttttcagcatcctctttcatttgctctttcagcgcgttttcatcctgtcctgagaattggaagtaaagctcaaggttcatgccctgcatttgcagacgctgttcgaattctttcatcatgcggtcaagctctgtgtcgatcatcgcttgaggaatgtcagcctcagcgttttcagctgctttcaagacaagctcttcgcgaagtttagcgtccgcttcgttttcctttgcttcttcgagacgttttttcgttttttcagtcagctcggcaagcgttccaacttcctcgtcgacatctttcgcaaactcgtcatcaagctcaggaagctccttcgctttgatttcgtgaattttcactttgaataccgcaggtttgcccgcaagctcttccgcgtggtattcctctgggaatgtcacttcaacgtctttttcagcaccggcttcaagtccgacaagctgatcttcaaagcccgggatgaaagagcctgaaccgacttcaagggaatagttttccgcttttccgccttcgaatgcttcgccgtctacgaatccttcgaagtcaagaacaacagtgtccccttcttcaactttgccgtcttcttttacaacgagttcagcctggcgctcttggagagacttaagttcgttttgaacgtcctcatccgttacggcagtatcgtctttttcaatgccaaggcctttgtattcgccaagtttcacttcaggcttaaccgttaccttcgcagtgaagatcaggttttcgcctttttcgattttttccacatcgatttccggacggtcaacaggctcaatgcctgcttcctctaccgctttcggatattcgacaggaagcaggatgtccagcgcatcctgataaagcgcctctacgccaaaacgctgttcaaacaaaccgcgcggcactttccctttgcggaatccaggaatggatacttgctttactacttttttaaatgcatcatcaagggctttattaaaggtatcggcatctacctcaaccgttaaaacgccttcgtttccttcttgcttttcccattttactgacatgtgtttccctccaaaatctattcaggttgtgtcggttttccattttaaaacaagcaaacggctacgtccatcgcaagctgccgactgtgtgcagctcatgtgtttctgacagccatcattatgtatacaaagataaataatgaatctttagcggcaaacggatcaacttccgtttttcacaaatgcaaccactatattataacacaatgcctgctgctttcaacatttacaaataagaaatttcttctatgtctttgatcagcgcgcaggcttcgtcaagctgtctgtcattgaattcatagagaatatgaagctcctctttatcgatgtcgatcccgtgcatctcatatccgactttatgcagtgcagcagcccagagctcgcggtttgagtatttcggctgaaacggatagaggacgtaaatatgccttctccacagctcttcgaccgcctggtacagcgtgggattttcattccccagcgtatcatcgagcacgctcagaacatgctttaatatcggcatgtcatcaggcttgaccgtctctgtcggattaattgtcatcgaatcgccaaattttgcgacaagcgtcggcttttcatggtctgactcggctaaaagctgaagaatcatcgtttttacgacaggatgtgcgctcgggttttgcagaatcgttttcaacaagccgatatagcttgtcagattgcggtccttcagcccgtgaagaagcttaacctgctcttccgtgtcattcaaaagcctttcctgatcaacctcctccgtctcgggaaggtcttcggtgatgtcctcaggccccgggtcttccgtcatcttgcggctgaaatcaaggagcttataaaactgttccgcgctttcaggaggaagcttgttttcttcgagtacagcttcaatcgtttctttaactttttcgtattgtctgagctggattaaaatcgtcatatagacttgcaaaacggtaaaatagtggccgtggccttccttcagcattttttcgcagatgcctttcgcttcttcaagctcgccgatttcaagcaggcagatggccattcccagataaatatcagattcctcatcatcatagcgcttcgcttcagaaaacagcctgagcgcttcatggtaattcttttctttgagcgcacccatccctttgtgcactaaacgctcctttacgttcgggaacgggatgatcttcgagttcttcttgtcatgcttcatttctaagttcctttcaggcacttattttttaacaagtgtatcaacccggcccgctaaacacaagaaagaaccggcggcagtatgctgccgccagcaaaaaaagcctccgatctacatcggacagcttttttatgcttgcagccaagaacttctctgtttctcaaattgttcgatttcttcttcaaggagcaatgttaaagaaatttcgtcgtaaccgttcagcagcatctctttccaatgcggatcgacctcaaaggcaatctgccgcccggcatgatctgttatcgtctgtttttcgagatcgaccgtcatcgtcaaagattgatactcatactgttcagcaagctctttccacgcctcataaggaaggcggatcggcagcatgccgtttttaaaacagttttggtgaaagatatcggcaaaagacggcgcgataatgattttaaatccgtagtcgtcaagcgcccatggcgcgtgttcccttgaagagccgcagccgaagttttcgccggcgattaaaatcgaagcgcctttgtattccggccggttcagttcaaaatcaggattgggatcgccgttatccagatagcgccagtcaaagaaagcaaaacggccgtatcccgttctttcgatcctttttaaaaattgcttcggaatgatctggtccgtgtctacgttgattctgtttagcaccgccgctattccgttatgggtctttaatggctccatcttgtcactcctctatacagctgttgtctcttggtaatattttctgacatcgacaaagcggccgtgaatcgcggccatcgcagccatcgccgggctgacgagatgcgttctggctcctttgccctgcctgccttcaaaattgcggttggaagtcgaagcgcagcgctctccttcagggacaacatcattgttcatgctcaaacacatgctgcatcccgattctctccattcaaagcccgcttcgatgaaaatcttgtgaagcccttctttttccgcttggattttgacgctttgcgagccgggtacgacgatcgctctgacgccgtcggcgactttttgacctttaatcatttcggccgcctggcgaagatctgtcatacgcgagttggtgcatgaaccgataaagacatgctcaattgtaatgtcctcgatttttttatatggttcaagacccatatattcatatgcgcgctgcgcttcttttttatcgtcttcctgcaagaaagcctcaggccccggaatcgtttcatcaaccggcagcaccatgccagggttgatgccccacgtcaccatcggagaaatggcgcttccgtccatcacgatcgtccggtcgtagaccgcccccggatcggttttcaggttcttccattcttctacagctttctcaaaatcctcgccttttggcgcatatttttttgttttgacatattcaaacgtcgtctcatccggtgcaatcaatccagctcttgccccagcttcgattgacatgttgcaaaccgtcatccgttcgtccatcgacatgtttcggaacacttcgccggtatattcaatgacatagcccgcaccgaatttaaccccgtattttccgatgatcgccagaatgacgtctttagccgtcactcctttttgcagtttgccgtcaacgcggatttccagcgtcttcggtttttgctgccaaagcgtctgcgttgacaagacgtgttcgacttcgctcgttccgattccgaaagcgagcgcgccaaacgctccgtgtgtggatgtatggctgtctccgcaaacgatcgttttgcccgggagcgtcaatcccagttcaggcccgatgacatggacgatcccctggtctacgcttgacaagtctgcaaggcggatgccgaattcttcgcaattccgttcgagcgcactgacctgccgtttagcgacatcatctttaatctcaaaccgattgacagtcggaatgttgtggtccatcgtggcaaacgtattttgaggccgtctgacttttctgttcttttgcctcaggccttcaaaggcctgaggcgacgttacctcatgtatcagatgcagatcgatatagagaaggtcaggcttcccttcaccttttttaatcacgtgttgatcccaaattttttcgatgatcgttcgaggcatcatctttcttcctccctctaccaatatccattttccttaaacgtaagcggtcatgatgtttgaaatggcattgtcgtctgccagcgcggcttttacttcccctgtaatcgattgagttgtgcaatgttccgagccttttgccaggtctttcgtccgttttcctgcccggagaacttgatcgactgcatgttcaacagcttgcgcttcagcttcaagaccgaatgacgtcctgagcatcatagccgcggacaagatcgccgcaagcggattggcaatgttctgtcccgcgatatcaggagccgagccgtgcacaggttcgtataaatgaagtccagagcttgataagctggccgacggcagcatgccgagcgatccggtcagcatcgatgcttcatcgcttaaaatatcgccgaacatgttttctgtcacgataatatcaaactgtccaggcgcatagatgagctgcatggctgcattgtcgacgagcatgtgctcaagcttgacgtcaggaaactctttcgccacttcttccgccgtcttgcgccatagtttgcttgactcaagaacgttggctttatcaacggaggtcactttgccttttcgactctgcgccatttggaaggcttccctgatgaccctttccatttccgactttttataaaacagcgtgtcaaccgcttcttcctcgccgttctgattgacgtactgctcgctcggctttccaaaatacaagccgcccgtcagctcgcgaacgatgacaaagtcaacaccttcgatatattcggtttttaacggagaagctcccgcaaggctttcaaatactttaacaggccgcagattggcaaaaagatcgagctgcttgcggatggcgagcagccctttttcaggccgcagctcagaaggattttgatcccatttcggcccgcctacagctccgagcaaaatggcgtccgcagctttgcaggcggcgacagtttcctcaggaagcggcgctcctgcctcatcaattgccgccccgccgatcaggccgtattcaaattcgaattcatgctgataatgttcagcaacgcttttcagcacatcaacagccgcgtccaatacttcgggaccaattccgtcaccgggcaaaagtgcgattcgttttttcaaattcaacaaactccttccttcttactgttatgatcctacagccgcctgttttgacaatccttccgtattcgtcttcaatacgagatagcggttcacagcattcaagtaggctttggcagatgcttcgagaacatcctgggcaaccccgcgtcctcccgattcttttccatcgatcatcaccctgacgtatacttgcgcgaatgcatcctgtcccttgcggttggattgaatccggtaatcaaggagctggacttctttatccatacagcgcttcagcgtgttgtacaccgcttcaacgcttcccgctccggtcgccgcttcctggatgacctgatccgtttcctgatctttaagggagactgttgctgtcggaacctgggaggtgccgtaatgaacctgcagtgaaataaaatcatagccgattttgcggtctgccgttttctcttcgagtatcagcgagatgagatcttcatccgtaaattcctttttctttccggtaagctctttaaaaatgttgaagaatttattgatttcttcttctccaagctggaatccgaggttttgcagcttatctttaaatgcgtggcgccctgaatgctttccgagcacaagcgcatccgttttcacgccgacaagttccggagaaataatttcatatgttgttttttcttttaagaagccgtcctggtgaatgcctgattcgtgggcaaaggcattatcgccgacaaccgctttgttccgcggcacggccatgccggtcagcttgctcactaaatcacttgtccgtttaatctcattcagctgaatcgttgattccgcctggtagaaatcttttcggatatggagggcgacggcgatttcttcaagcgaggcgttccccgctctttcgcctatgccgttgatgaccgattcgacttgatccgctccgttttcaatcgcagccaaagagttggcgacagccatgcccaagtcatcgtggcaatgggctgaaagctggactttgtcggcattgcgggcattttctttaatatggcggaagatatttccatactcggcaggcgctaaataaccgaccgtatccggcagattgacgacatccgctcccgcagcgatcacttcgcttacaatctcggctaaaaacggaagatcagtccggcacgcatcttcggcagaccactggacgatcgggaagcgttctttggcgtatttcaccattgcgaccgcctgttccagaacctgttcgcgcgtttttttcagcttatattttaagtggatgtcagaagtggcgataaaaatgtgaagccttggttcagctccgtctttgagcgcttcccacgccgagtcgatatctcctttgacagagcgggcaagccctgttaccgaacagtttttaatcgtccttgcgatttcttttactgcattgaaatccccgggggatgaagcgggaaagcccgcttccataatgttgaccccgagtttttcaagctgctgggcgatcgccagcttctcctgcgtgtttaaattaacgcccggcgactgttcaccgtcacggagtgtcgtatcaaaaaagttaatttttcgcaccggctaccaccgcttcctttttcttgccctgcttgacaaacggcatcatttcgcgaagctttctgccgaccacttcgatttggtgttcgttttcgcttgcattgatggcgttgaaacgcggacggttgacttggttttcgacgatccactcttttgcgaatgtaccgttttggatgtctttcaatacttctttcattgattcttttaccttctcatcgacaacgcgcggacctgatacgaagtctccccactgcgctgtgtcggaaatcgaatatctcatccctgccaaaccttcttcatacatcaagtcgacgatgagcttcagctcgtgcagacactcgaagtatgcgagttcaggctgatagcccgcttctgtcagcgtttcgaacccggctttgacaagggaagtcaatcctccgcacagcaccgcctgttctccgaaaagatcggtttcagtttcttctttaaatgttgtttcaagaacaccggctcttgcgccgccgatcgctttagcataagcaagggctttgtctttcgcttcccctgtcacatcctgatagatcgcaaacagcgccggaacccccgcaccttgttcaaacgttcttctgacaagatgtcccggtcctttaggagcgacaaggaatacgtcaacatccgccggaggcacgatctgatggaaatgaacgttgaatccgtgggcgaatacaagtgaattgccagcttgaagtccgtctttaatttccgcttcatacactttttgctgctgttcatccggaagaagcaccatgacgatgtcggcctgttctgccgcttctcttaccgtgaaaacttgatggccgtcttcctctgcttttgcaaaggatttcccttttctgacgccgacaatgacgtccactccgctttctttcaggttcagtgcgtgcgcatggccttgtgagccgtatccgatcaccgctacttttttgcctgctaatacgttttctttgatatcaccgttataatatacttttaccatttcaatctctccctttttatgatttatacaatagatattgttttaatagaggccggcttttgctgagttcccctcgcaaaggccgtggtgcctgttctggctacctctttaatcccgtatggtttcaatagttcgatcagggcttcgatcttgctcgattcccctgtcacttgaatcacgacgctgtcttttgcgacatcgacgacagacgcccgaaacggttcgatgacgccgtttatttccgtcctgctcgacggaggggaaaccaccctgattaacgccagctctctttggacgatcgattgattcgtaatgtccgtgactttcagtacatcaatctgcttgtttaattgttttgtcagctgttccgtttctttttcatctgccacatgaacaacaaacgtgattctggaaattcccgcggtttcggtgtggccgaccgtaatgctttcaatgttgtaatgccgttttgtaaacaaccctgtgattctgtttaagacgccgctttggttcaaaaccgtcagcgtgatgattcttttcaaggtttcacccccaccatttcgtgcagcccttttccaggcgcaaccattggaaatactttttcagcttgtgcaacttgaacatcaatgaccatcggttcattcgacgttagcgccgcttccagcttttcttccgcttcttcttcggatgtgattcggacgcctttgatgccgtaagcttcagacagcttgatgaaatcaggctgtgatgtgaacttggagtgcgaatagcgctcatcgtaaaagatttcctgccattgccggaccattccgaggcagcggttgtttaagaccacgaccttgatcggaaggttcagatcgtgaataacagacagctcctgcagcgtcatctggaatcctccgtcgccgagtatcgatacaaccgtcgcatccttatccgcaagctgtgctccgattgccgccggaagtccgaagcccattgtgccgagcccgccggaagtgacccatctgtcggctttttggaactgataaaattgcgcggcccacatttggtgctgtccgacgtctgttgttacaatagcttcgccctttgtatagcggtggatatattcgatcagcttctgcggtttgaatccttctgtttcattttcttcataccagagcggatattcggttttccatgccgcaagctgctttttccactcatcagaagcgctcggcttgccgttttgcttgatcagctccgtcagtacaagcttgctgtcgccgacaaccggaatgtgcgtatgaacgtttttgccgatttcagccggatcgatgtcaatgtgagcgactttcgcatattttgcaaaatgcttcaagttccctgtgacccggtcatcaaacctggcaccgatgctgattaacagatcgctttcatacagagccatgttggccgcatacgttccgtgcattccggccatcccgaggaaaagcggatgatcggccggaaatcctcccaagcctaacagcgtatgtgccaccggaatctgctgctgttcgacataattttttaattcttctgacgctttcccgtgcaagacgcccgcacccgctaaaataaccggctttttcgctgcactgaccgcttccacaagctttctgatctgcagataattcggttccttcgtcggctgatagcccggaaggtgaatgtcgtggtcatagcggaattctccttctacaacggcgatgtctttaggaatatcgattaaaacggggcccggtcttcctgttgttgcgatatggaatgcttctttaataattctcggcaaatcttcggcattgcgtacctggtagctgtgctttgtaatcggcatcgtaattccgatgacgtccgcttcttggaatgcgtcagatccgataaccgatgtcgcaacctgaccggtgaatacgacgagaggcaatgaatcgatcatcgcgtcggccagacccgttacaaggttggtcgctcccggtccggatgtagcgatgacgacacccggtttcccggaaatccttgcatatccttcggctgcgtggatggcgccttgttcatggcgcgtcagcacatgaaacattcccgatccgtagagtttgtcataaatcggcaggaccgcaccgcccggatacccgtagatcacttcaacattttcctgttttaaagcctcgatcagcattgacgcccctgccattgtttgtgtacattgggcattttcagcatccaactgtacattcgtccccatttttcttcctccttatcaagtgatcatcatcactgttcattcacaattgtttttcaaaaaataatcaatatatatgtgccgcaaagcatgtatccaatctgcttttgcagctaaaaaaagccttcccgcccactgttgacgctgcacaccttgcaggccaaaggggcgaaaaggcttttctttccgcggtaccacccttgttcgcggcttttgaaagccgccttatggataatcgcttatccggtttaataacgagtgaaccttcgtaatgttcacccggccagccctactaaacatggaaatcgttcagactgacactcagaggggagttcacaagcggaggccgtcaccggttcccagcaatcccggctctctgcaggcggcgtttccgctgctacttatcctcttcaacgtttatctttattcagctgacacttaagctttgatctttgaggctgacttttaacccttcacggacgacgcgctcgcggaacttttcaagcatccggtttgtgtggactcccggtttgccgtccccgatcttgcggccgtcaacttttacgaccgcgatgacttctgcagccgttccggttaaaaacacttcctcggctgtgtatacgtcatggcgggtaaacggctcttctttcacttcatagccgagctctcgcgctatttcgatgatggcattccgggtgattccttcaagcgctccgatatagcccggaggcgtcaagagctttccgtttttataaataaatacgttatccgcagacccttcggcgacatagccttgatcattgagcatgagcgcttccgtcacacccgccatatgcgcctcgatccggacaagaatattgtttaagtagttcagtgattttactttagggctcagcacatcgggtctgttccttcttgtcggaaccgtaacaatgtcaatccccgtttcatataaatgtttcgggaatattgccaatggttcgacaattatgatgacactcgggtttgaacaattgtttggatcgagtccgaggtcacctgctcctcttgaaacgaccaagcggatgtaagcgtctttcagcccgtttttttcgactgttttgagtacgtgctgtgtcagttcttcctgtggatatggaatctccagcatgatcgatctcgcagaatcgtagaggcggtccatgtgctcttgcattctgaagatgttgccgtcgtataccctgatcccttcaaacacgccgtccccgtataaaaatccgtgatcatagactgatattttagcgtcttcttttttaacgagtttgtcgtttaggaagatccactggtctttctggtcccccatccctctagcacacctttctgttgtaaatgaacgctttaaacgattaaaaattcatgatgcgggaacccgttttcccgctgtcattcccgggaaagatgaaaagttttcaagtgatttgttcttttgtttgaactcatattacgcccctttacatgcagtgtcaaccgtattttttaaaattattagacaattttgattaatcaatctacttgtatacgcttacatgattgatataaaaggaaatgtaaaattgaaaaacaatttaaaattttttatgtaatctataaagattacataaaaaaactggcgttttatacagttttgttagattttatcccgacaattttttataatttcatccccgccggttagattttttgccacatatatgtacagactccattttacgattttttacataaactggtgttaatcaaaaagaaacaggtgaatatgatgtaccgcacatttcctgcgcactctgttccccgcgtgcgccaatacccgggatacttcggctacccggttacttatgtctataatccttcagcacacgggccatatacctattatccgtacggcggggtgttcaccactccgacgctcggattcggcatcggctacccgggaatttccgttccggctgtacacgcctttaccggtggattcagagacaatgaataaagcacaaaaaaagagagggcatcatgctctctctttttaccgttaaacgactccctgagcgatcatcgcatccgccactttgataaatccggctatattgcagccgtcgagcagatttccgggccgtccgtattctgaagccgcttcaacgcttctcttgtaaatatcagccatgatcgccctgagcttcgcatccgtttcttccgccgtccagtgaagccgtgcgctgttctgcgccatttcgagcgctgaaacggctacaccgccggcatttgcagccttagccggtccgaatagaactcccgcatccaaaaagcgtttgacggcgccctcttcagacggcatatttgctccttctccgacagctttgaccccatttgaaatgagcacttcggccgcctcttcgtcaatttcgttctgggtcgcgcacggaagcgcgatatcgcatggaatagaccaaatgccggtacatccctcgaaatagtgtgcttccggatgctcgctgacatactcgcgaatccttccgttcccgtcttctttgagccgcttcaccgtctcaagacagatgcctttttcgtcatagacatagccgtcagaatcgctgcaggccaccactttcgcaccgaattgagcggctttttccatcgcgtacagcgccacattccctgaaccggagacgacaacggtgctgttttcaaagcgcagcccctgatccttcagcatttcttccacgaaataaaccagaccgtaccctgtcgcttctttcctcgttaaactgcccccgtattcaaggcctttgcctgttaacacgcctgcatcatagcggccccgaatctttttatactgtccgaacataaacccgacttcccttgctccgacaccaatatcgccggcagggatatccgtgtccggtccgatatgtctgtacagttcattcatgaagctctgcgtaaaactcataatctccctgtccgatttgcccttcggatcaaaatcagccccgccttttccgcctccgatcggcagtccggtcaaagaatttttaaaaatctgctcaaaacccaaaaatttaataatgctcgcgttcacagaagggtgaaagcggatgccgcctttatacggaccgattgcactgttaaattgaacccggaaccctcggttaacccggatattgccttcatcatcgacccacggcaccctgaaggtgatcatccgttccggctctgcgatcctctcaagaatgcggtgttcgatatactttggatgccttgccaatacagggacaagggaatcaaatatttcctttacagcttgaagaaattcgctttcgtaaaaatttcgcttctgtactgtctcgtatgcttgtgtcacataatctctcgccgtctggaaatttgtttgctccattttttctagcgtatgcaccttttttcagctccctttctaaaataaaagcagaacgaacattgtaagattttctctcatggtaaattttacaaccaatgccccatttacatcaatctggaaaacagataaaaccattgctgaattgagatgtataacaaaaagcgagaatagacgggtcataagatagaaggacagctcttaaaagctgaggagaaaaggaccaataaaccataaaataccactttatctgacaggttctttctgtacaaaatgtctattttctttgtgatcggcgcatttccccccttgtactcccggcagagaatgagcatcttatcccgtttttaaaatgaaacctactgcatacaaaacgaaaacacatagctcccctttttcatggcaacaataaaactaaaacaggggtgatctgatggacgacaaaaaagaaatgtcgaacgttgaaacgcaaagaaactttttaacagctgaagaatttcctgaaggtgcgtatggagctgcacagggcaaagacgagcccgttgagaacaaaagcacgccatggaaggaaggccagcaatactacagcaatttcgcatacgaattccgcaatcttcatcaaggaacgccgcgtcaatatcccggagcgcatccaacccatgacgaagaggatcaaaacgaggaatgaccgatataaaaaagagccgtgctaaacggctctttacagctttttattgtagaggctgttgaaaattttgattttgctgctggttttgttgattttgctgaccctgttgtccttgttgcccttgctggttaaatgactgctgcgcctgctgaagcgcctggctcatttggttcatggcctggtttgtctggatcccttgaagagcctgattcagctgctggacagcctgctgaatgctttgctgaatttgctgatccgtctgctgcatttgctgctgagattgggagctgaactgctgaatttgctgtttcagctgattgattccctggctcaattgagagctctgctggccgctttggccctgctgctgtgaccccatttgattaacagtttgctccagctgggcaagctgctgctggatgtttccgaattcctgagcaagttcggtatctgtgatgttggccccgagcagctgctcatgcttttgtttttgttgcttctgcttttgctgctgattttgctgttgttttgtcattacaacatcctccttaaaattgatcacaccctttagctttttcattttgtttgaaatgatgaaagggaatttttaggatgttgttgttttgcaacaccaaaagcctcaaacccttgtatgccaagaagtttgaggcttttttcagtgacgtcccaggggagattcgaactcccgaccgatggcttagaaggccgatgacccttatggacagcatgtgacaccacttaaccgaaagcccatgatatcaaggttctttgctcttttttgttttctggaggaacgaaaaatacctgattgggagcgaatccgctccccgctcgctcccaattttccaattaattcgtaagtttaaaaagtggacattcgttcccctgttgccaaaagcaaaatccaggttttacatcatctccgttaatatcaaaggtgtactctacatcaaaaccaaaaaccgagaatatttggtcttataggcatggatgcactgctgcaggatcgttgaatactctgcggtgcttttcaattccttcaaactataaggcggctcgatgatgtcatttcctttatagtcgaattgatcttcgtaaatctgtttggtcgtttcacttggggcatttgccttgaacacggtggctttcacagattgttgagccatgcttacctcctctctctattcggccgcggccggattttcggtttctccttcagatcggtgacctcgtaatcatcgagggcgtaccagatagccgaaagagtgtggggatcgcgatcttgaattcatcttcaatgatgctacccagcttgtcctttttataggtcagcggcttgagttcaaaaatggtgttcctgcattggccggaacaaatgatctttttaaaccgcttgatctttttcgtatactgcaggcgcgaaccctggtacttgtgagctcccaccatattgaaaccctgctgccggaaatattgaatcgttttagctccgctgaatcagctttgatcaactcctgggttttcttgaattcttggagctcctctgctgtccggtcatccgtcattcctcttttgtaatattcccaatagatatagaggtactttttcttatgatctaccgcaagccggacaacggcgttataggattcctcaaaaccaaagtccatgcctacccgcttgatgggacggtcaatgttcgagatggcctgcataacttcatcatgtggccactcttcaaactgaggaaaaacccgaaccccattcacgccaaaatgacctttcctggcgatgcggtaaaggtctggatcgtattctttcagttcatccagctgccttacatagctttctggcagaaacaaattatcttccgccgtggaatgatgatagtatgtgtcatttaaaacgatcgttcgcttttcataaagctctttatcatccaggacaaatcgattattcagatcgtctttaaagaaatgcttatacgtccagttgtcttccccgaccggattcgtggaaaaaatcatatgaagcggcagcgtaggatgccgcagacggccgagaagctctttaaagccttcatatttgacctctgaacattcctcaatccatattattgagatgttgttgatcgatttcagtttggccggtttgtccagccccttgaagatgatccggctgccatttgggaacctgacttgcatcggagatgtcatacacctcacaatatgatcaatctctaagtcattgatgatcccttcaaaaagagagaatgtagaatcccgatgagtgtcgtacacttcacgaatgactaagactgtccgtttttcttcaagaagcttcaaaatgagcttgagagcaatgtgatagcttttggatgatccgtaaccgccaacgagcagctgaaatttttggttccagtcaaagagaaaatcttcaaaatgcggattgacttcttttaccgtcatttgccgtcacccttacgagtaattgtgatattcacagaattgtccacagggcgggcggtaaggcgttcaagctctgcttgttttgtctcatttgaaagatagatgccgcggagcttcaattcatgttcatccattaagcggatcatatcgtatttctggcgaatggctttcaaccgtttatccgttacacgggtgagcgcctcctcgatattcaaaatatcatcaatagccctcatctcggtttcttcaatttcagtcacaacaagacgctcattcataaccgggacgggtttgactagtccattcttatccggggtttgaacgatgtccttgaccttgcgcatttgctgaagcacgcggcgctgcttttcagataaaccgttctggattctatttattcgctgcatcatccgccgctcccgaagactcaactccctgatcgttaaatcaatttgataaagcggatcggtttcaatttctccaaatagctgtcgctcgtcctcatttaaaaagtcccacatgatcgtttcatattcgccggtacggacggaatttttattcccttttggagcagcaccacccctattccctttcgcattttcgtttccaggcggtgcattcccgcccttgtttcctttggcgtttttattgcctattggagcaccgggacgaaaaggagcgctcccattcgatttaggagcgctccctttgattttatcttcccatttatctattgctttccacttgcggacggtactgcttgagacgcccaattcatccgcgatgtcttttaatttcttggttccgctgctttctttccataaacggaacgcttcgtcacgtcttggatcacgcggtctggccattacatttcacccacctccgcaacctgaattgagtttgagtttgttttacttattttcttttgttggctttgaagctatttgcgctatagatatagattcagcagctctttttagtgcatcaatacctccgattttttgggcacgctccatcgcttccgctaagtgagagaaatcaggaatgctaaaatagctttgttttctttcaatattatttactaattctaaaagtgactctgattgtggtttcttcaagttcaaatttcttatctcttttcgtaattcctcaatcgtatcttgtgattcttgtttctctttattgagctctttaaaccgctctaatgtttcttttattgaatttaccatttcgtctgcactaccagccaatctattcaacactagtaactgattagttaatatttgatcaccgacataataaggataacgaagttgatggtctatctcactccaaccctcttcaaaaattgtacgaatctgtatctcagccaatgtctcttctttagttaaacgactttttattaaatagtgccaggaacgataaccagcagaatgttttttaacattgaatttcccttctgcttctaattcagctttctcatcatcatctatgtcaccatgtctaaaatagatagtgactggctctgctaactcccaattttctcttatcatctcatcaagatttattgcctgatctttatataaatgaagaactctcactccaattaagtcagttattttcgtcttataatcctttaaatcaaaggaaaagtcattattttcggccttttttcttatcaatttctcgataagatgttcaggattttttattctcattctaacagtatgggcatcaggatgagttcttaatagatcagcaatcgttttccctgtactttcaagcagcggcctataagatatataatcattgtaaatcgactttaattcctcccattttaaatcagtaccttcgaaagtttcttctttgattctatatttttcgaaaaaactttttttatccattaactcagacataatttctcccccatttaggcattactatcaatttttttatgtcattcaagaaaattcttatattcattatgcattaataaacccaaatagggaatatattccctaaatttcttcatctttctgcagctgtatatcgagctcgatgagcttttttaaatcttcaacagtgttcaccttaatatgaccgctttgaaaatctttgacccattgggtgatacctgcctgaataatttttcgatatttctctttagattgactgatgttttcaagcaattcagcgctatgcaggagaagcagtttctctttttctttatcatcgcaggaacgtatgtttgtattttatattgccatttgcctggtcctccaatagaatagagatgagagcgtgattttcccacgaaacgcggccgcgtcttcatcacgctcttaccagggtgatggccttgggtaagggagggtgttgtcagcaccctctttataaaaataagccctaactagggcttggtgaatttgttattttaatatgaggtaattcataaatattaaatagtattaaatctaatgtttctagatataacaataaatctctccgtttcggtcgaaatatttcatgtactgtctgatttcctacatctttaatttccaagagtatccttcgttgttcctcatcaattatattcttttctttaagttcatttatcttttgaaccaaatttaaattgaccattaccgggtttttatcaccatctaacactggttctcccttcttaatcttcggtcttttatcaattccatttaccatacatattgattcaataagcattctaattcccgtattgcataataaattcatacgttggcgataagcattaattgtttcatttctaattccatttattaagttaggtaagtgatcgaattcatatttttctttgaattgtaataactgttctaccggatcctccttttttggctcttctggaaagacagtgtattcgacaaagtattctctatcagtatgataatttgaaccgactatatgaaacatatcttcatcgccgtatatttttagaaaagcaatagcgtcacaacctctacattgaactattgcataatcctcattaaattgaaaatcaatttcttcatcataatctaaattacttattgaatactttagttcattgtcatgctcatttttaactatctgatggtttgtttttctcttacaagctctacagtacaatttctccggcacaacggtcatatattccaccctttttagaaaaataataacatttttctaaatgtagtgagaattattaaaaccactgattgtaaatctgttccgatatttttttcatcatgaccggaggaacactcatcccacaaacatattgaacagatgcgtccataaaatcataatcgagtgggaaagattgcattaaaatgatatcccgttcagagatatagtagggctcatcataacggacaaataccgaaccactcccgagagtaggcgggacaaggctatttttcactaatatcgtattgaaattagattctttcccttcaatccttttcgtgatgtctcccattattatccgacggccgtcgcttcacccatcttttataaagctttgatgtttctttaagccttgcaccatggccgcttctgaattctttatatacaatcggtggctcattgaaggacaatttaagcggtagtaaattcaagtccttccttcggcaaataaaaaagacccgctctctacgttgcggggctcccattgtggcagcattcaacaagaacagttgaacatcatatccaatttccttggcccgttcaatcaccagcttcacataaccttttgcatttccgctgaccattcctttgacattctcggccacaaagatttttggccgcagcctttcaacagcatcaaggtaatgaaaaaatagatcatcaagtgactgttttgcctgtccttcacgaaaggctttttcttttccccaagccttttcccgatcccccgcaatagaaaacacgctgcagggcggggaaccatcaaaaatatctaaatcgaacaattcatcaggcagattttccattttgttaaagtctctgatgtccataagaaaaggatatatcggattatgattcttcctgtaaatcttcatcatttgcggatcgatctcacagttccccaaaagatcgtaaccggcgagcttatagcccatagaggaacccccgccgcaagagaatgtactgaatactttaaggccatttttcttgatgttttttaaatcgcccaacttccaacggtactctttcttttccatgtaatcatctattcattaaatgaaaatccgcatttggggcaggtatgttggaaatgatcatcttcataatcatccaggtctaattcctggctgtcattgatttttccttcgttgccttcatgctcagccagctctcccaagatttcatctatttcactttctgagaagcctgtaagggatagatcaaaattattgtgctgcaggtcttccaaaacctgttcaagtttgtaatcatcccagtcaccgctgatcttatttaaagccaggttgagcgctttttcctcagcctcatcaaaatttacaactgaaaccaggagagtctttggattttcttccatgaggacgcaaagattataggaagccatataaaaatgacttcctgtgcaaacgggatctcaccgcttgcgttccccgcgactatcgcgcgcaatcctgcatagactccagccgctcctcctttgaagctgacgatcttcatcatcattcgatacatccgagttcacccttgataagggaaaggtgcgtctcccattctggccaataaaaaagcggccaccaatcagctgcacaacatccgtgtgcaaaagatcagtgtccgcaggctctccgtcttggactcgatattcacgttcgtttttcttgtctctatcgtatgacaaaatggaatagaaaaagtcccccattttatccccctttttgtcggctttttctcggatatctaaccattaaacagcaacttcttcataaaaaaactcccctttcatagggagcttattattaattattatttgaatttaaatactcttccaagaatctaatattatcttcatcattaggaaaaatgcctaagttcttatattcccagataatttgtcgttgagaaccatttaaatctgatttaattacatcatcataattataatccattgaaaactttccatttctctcgagtgttaaagtgagatttgtccaaacttcggaattattttgtttaaactcattttgcagatcctcaaataaatcatgaagctcaaacaataactcatcatagatatcttcactaacattgaaatgttcaggtatgttatgagaataaatataatccttattttgcggtacattaaaataaaagaaaacctctgatgaatcatctaatatttcagcatagagatagaccttttcccattcagtagggatgatttcgttaatcccctctgctatctcttggtataatttttccatcttttcagtttccataaatattaacctccattctcatttttaattcttatttttttgattttttcattcccaattttatattcgactttaaaataatccggtcttaaagagtcatttttatatatagggctgatcttgaccttaactttttttgggggaacttcttttaaagcgttcctccattcttgttccatctcataccactttccgcctcttctattaacctgagaattcataggcacaagattatctatgtcccctgaacctttaaattgagaagcaattaaatgtcctccgtcatcatctggcagtctatctggtttaccaacgttagattgagcatacagatttctttttgcttttccaagttgcaaatcggcatttacactattaattcgacctttttgatccgttttaaacgtatagccctgttttgtttcatacacaacgtttggcttcaaaacttttttacgatttaatctggtatactggtctccgtattttactgtatgtactgcatgactatctgcttttccaggttttttcccactattagctttaaaaagcacactcttcttcttatcctcaaccagctctctcagcaaaggcgtatttttcacattaggggcctctcccgctctttggagcatcccttctaatgcaggagtatagcgatttttaggcgggctgaaatgttgtttaacagagttaacacttttctttgctgtttgggctgcagccttgccagctttgccaagactttttgagcctgatacgacagtaggaccggcctctgccaacccccatatcgtcccaatcgcataagcaatatagtgtccgcgagaatatgaatccccatgtaccattttttcgtcccacgaatctgcgattgattgcaacatactttcaaaagcggctttgtaatcatactcaagtactgaatttacagttgcttttgggtttttaataaagtcgtctgcttgtccaataagagctttacctgtttcaatcgttccttggatcgtatcttttgcaaattcatatcctccaaccacaaagcctttcatactttctaagacatgttttccatcttccagagttcctttaattggatctgctctgaactcataagcttcttcaatggcagtaacataattcatctgttcagatgtaagattatcatatccaatctctctagcaactttgagaaactcatccggatcatcatacaacttttcaagttttttcttcaacgtatcagtatgactcataggttctattttgctggcctctttttcaagctttgatctcttatccagcttatccaacatgacgcccatcgctgtgtcttgtccaccacgcaaagcatccatctcatccggctttaaaatcgagcctttttggtaaccggtaatttcaattttagggcctgtgtacattttttcaagccggcttatgtatctctgcatcgtttccaggtcgttttcagcggttttaagagcgcttgtctgttcgcggtcgaaggcgtgcagcttttcaattgtctgattgatttcctttaaagctttctgattctgttcgtgaaaaccgctgtcattcaaatcaggcaaatcgacaatgtggctgacttttgcgatcgtggcatttgttttagaaaccaaacgcttcgtagtgcggtcggccgcattcaatccttgttccagctcgtgctcaagaaagctttgcgaaataaacccgttgtggtttggttccagcgaattcagcgcgcttttcattttcttcagcgtggaactgtattcctctatgaaagtatcatagaactgtagaaaaggggtgtggcattcctcgtaaaaggcgcggatcgcgtcgccgccttttccttttaaagcatcatcaagtgatgtaatgccctctacggcttttttgactttggataattcgtctgactgctgttttaattgttccagcgtttgatcaattgcatggtgcaacgcatggacatcaagagtcttcatggcattcccctctaatactaaagttacaatcagtatagattttaccactttacggaaagaaattggtgaataaatcctgtctatccatgaaaatgaatcttattgatcaggtcttaaaacccaacacagtcgacaggctttttttgaattccaaaaaaggaaaatcattgtaaaaaaatgatcctttctgtaaaatgaaaggtatgcagaaaaaggaaatggatacttatttttttgaatatttcaaatcaattatacgaaaggaatggtgggaattggttgttaaaatacgatccgaaaaggtcgggaatatgttgaatcaatggtatgcaacaattaagttacagcaagttcataaagcaactcaaatgaagaaagaaattcagaaggctattgataatatggagaagaatcaagatgttttgctttatttcaatatgatagattctcggtataaattattgatcgaaaaatataacgaatccggaagcatcttaaaaagtcttaagtatagagctgaagaaaagaagacggacgacatgcttcagtattacttttactttttcagcgggctgtatcagttttacataaagaactttacgaaagccattaatttttatcgcattgctgaaaattggataaataaaataccagacgaagcagaacgagcagaattcaattatcaaattgctattgcatattatgaaattcaccaaaattttttctcgttaacacacgcagaaaaagcgctcgaaagctttttagcccttggaaattatgaaaatagggcagcaaccactcaaatgataattgcggcaaacagactggatctacatcaatacgaattaactgagtccgtatataaaaaagcaataaaaatggctgctgatacccgacaaaattacgttgagggactcggacatcacaatctcggtcttgcttacgaacgacaagaaaaactcgatttagcgcgtgaatccttcgaaatagctctcgacatttttgaaaatctacattccaaaatcgcaatcatcagaacttcttatatgctggcaagggttttattcaagaaaggtttattcgaagaagggacacattggtatcaaaaagccctcaatctcgcaaaagaaataaacgaaaaaacgtacgaagccaagttattagccatacactcaatatataaagagttggataagaccttattagataaaggattgaatatgctaagagacaaaaagctttggtcagacgtagcagatttagctatcattgcagcaagacacttcaaaaagaaggaatatcatgaattagcggcgaaatacttcgatgaaggagtagtcgctcgcgacaaaattcaaacatggacggaggaacttgtctcatgaaaaaattacttttaggtgcagtaataacaggtgtatttttaactggtattttaaactttactactcaaggaaaagctgaattcggtactggagactttaaagttgctgaaaatgcgttttttggttaaatcataacgtgattcagttcggcccttaagattaaaaaagtacactttgataaagcggactcctgggagtctgcttttttgttcacaacagccctcagattatcccgagagctgtcgcaagattgtaaatggcccgccgtttgacctgatagcatttgtcctttttcaaccccatctccatataaatctcaatgtcctttattttttggggagagagatacttggcctttatgatctttaattcatcaccatcaaggctttgtttaagcgccctgtccatctgacaaactttcaattcatttaaagagtgctgatccctgagctgcaggaaaaggttattcatcccggccgcttcccgttctttccggttttcaagctgaacctttaaagccttatatctttttagctcccttataatcgtatttctgacttctttttcgtctataggcggcagaaaaagtcagttgtgtagctgacatgctaaatccctcctaaaaacaaattagacaccaataaacgtatatacaacgtcaatttggtgtccgcaggctctccgtcttggaccaatataaattcctgaatccatcagacttaattgttgtttctctcaaataatttcatttcgatggtaattcgatccctcactcgctttttcggcgtatttaccggaggcttctgcgccgtagtcaaatcggaaaaatcttcgtcgattgtgaaaatcggtttctttttcgtcaacaaaaaacgcctcctacttcgttaaattgaacggttcaaaattgcgtcggttttttaattgaccgttacatttaacgagtagaaagcgtatgatgacgggctttatcgccccattacgtgacgtcccaggagagattcgaactcccgaccgacggcttagaaggccgttgctctatccagctgagctactgggacatgatgttgttttgtttcgctttaactatcagcgacaagatttattatatgcggatcgggacataaagtcaacaactttttagaatttttttcttcacgaggaagaaaaaaattcttcctcatgaatgtgctggcaattgtacatggttcgtcaggctttcgacttcccggccgtccaagtcataatagcgaaccgttgcattgtctttgtcaatgtttagtatagcataagttttttctttccgcacccgcggaaggcggatgctgccggggttgatcagcagttttccgtccatcagctcgcttcccgcgatgtgggaatggccgaaacagatgatatcggcgccgagctcttcagcccggcagtacacatttaaaagcgactgtttaatgccgtataaatgcccgtgtgtgaaaaaaagctttctcgatccggcgggaacgacgatttcgtctttgaactccccgtaaaaatcgcagtttccttttaccgttaagtaagaggaaagcgcgggatgggaagggtccaattcagaatccccgcaatggatgatgagatctgtttccttcccgtgccgctcagcgatcatttccagttcgtcttcaaggccgtggctgtcgctgacaatcagaaccttcatgatcggccctcctcctttacgcttgatccaataaagcggacagctttttcagcgcttccgctctgtggctgattttgttcttttcgccgcttgagagctcggccatcgtttgatctttgtctttgacgagaaaaaccgggtcgtagccgaagccgtttgtgccgcgcggctcttcggtaatgtacccttccacagaaccttcgaccgttttcgtttcctgtccgggaatgcatattgcgagcgcgcatctgaacctcgcggaacggtcttctttttccaccccttcgagctctttcaatagctttttcagattggcgagatcgtttttctcttctcctgcatagcgggccgagtatacgccggggctgccgccgagatagtcgacagacaggccggagtcgtcggcaatcacgatttttccggtttctttcgaaattgtttccgctttaatcacagcgttttcttcaaaagtctgcccggtttcttcgatttcgggtgtatagccgatgtccagtaaagatttgacatcgtagcccctcggttcaagcatcgctttgaattccctgactttcccttcgtttttcgtggcaatgatgacttccttcatcgtgtatcagcctttctcatgttattgttgaatagataatgcaacgtcgccgagcacttctttctgcttttcgaggagttcggcgatccctttttcagccagctctaaaagcccgtccagttcacttcttgagaatgtcgcttcctctcctgttccctgaagttcgacaaagcggccttcgcctgtcatgacgacgttcatatcaacctcagctgcagaatcttcctggtagttcaaatcaaggatcaatcctttttccttatcgatgcccactgaagtggcagccaaaaagtcggtgatcggcatctccttcagcgcgcctttttcgacgagtcttccgacggcaagcgccatggcggtgaatgctccggtaatcgacgcagttctcgtacctccgtccgcctgaatgacgtcgcagtcgatccagatcgtccgctcaccgagcttttccaaatcaacaaccgcccgaagagctcgtccgatcagccgttggatttccatcgtccgcccggagattttcccttttgacgattccctgatcgtcctttggttcgtggcccgcggcagcatgctgtattccgcggtgatccagcccttcccttctcctctcaaaaagggcggtacgcggtcttccacagacgcgttgcatatcacctttgtcccgccgactgtaatcaggaccgatccttccggatgcgtaataaagtcgaggtccattgtgacagggcgcagttcattgttttttcttccatcgtatctcattttttacctccgattgtatgtacataaacctttcacaatcattccgctcttccaaaaagctgaataaagaaagaggcagctttgatcgctcacctctttttctatagtatatcaaaaatttcggcttaaaaactacctgtgttcaccttgctcggtcttgaaaccggcttggaaagcttttctcctttttcattcacgagctcggattttccgttcacggtaaccgacacacttttcacatcaggcagttcggttaatgtcaacacgatactgtttaacacttcatccgatatcacttttttctggccgtcggcacttccgtagatcgcttcgttaaagtcgagggttacatggccgtcttcaatcttcggcttgttttcaagcttgacgtcgccctggaaatcggagagcaggccgcttttattgtccggtccttcagtcagctctttaatcgccgccgtcacctgatctttttcttttgcagacgtccgctttgtcaccggaacgtaatatgtgcctttatctgattcagccaaataatagacggtgaccggctgtgtcgccgttatatctgtcacacccgccgtgtcgaggttaatgccgtcctcgcggctgagttcttctgaaatcggcgtgccgttaacaggcatttctttcaaatcatggccgttcatgcggagcttcactttatcaatcgagttaaactgcgttaacgtccatgtaatcgcctgtacgattttttgctcatcttcagctttatagtttttaaattcatttgagaaatcagcgatcgctgttccgtcttctttaatatcaacattgaccgttgtatccgccggcagcacggctctgaatccgtttggcaggatgtttgaaacagggccgccttcaacgaggtattcaagcgcttgtttagccgtcccttcctgctttggcagcggcagcgtctgcgctgtcacatagccgttcttatcaatgagataaagctctctcatgaccgtatcgcccgtttgagcggctttatcgtcgcttgtcgttttgctgcctttgtcttctgttttatctttggttttgtctgttttgtcttgctccttctcctcttttacatatgtgatgtcctgcggcggatctatctcctctgaggcttgatctgactgaaatattccgcacccggaaagaagcagcgcggaggccgtaaccgtaaccgcgattcctttcattccttttttcagcatacttttccctcctaaggcagtttgtactattatgtatacgagcccgtttttgaattagaccgctttttaaaaaaatccctctgaatacaaaaaaccttttctttaaaagaaaaggccatgaaaaaagctgccgtttgcatgtgcggcagctttattttacagcggtctcctgaagagaaatgctttccacatttttcacttcgtatccaaaccaatcgtttgcaatttttgtgaagcgggcgcgctccccagttgttaaaaacaagtgttccggcggttccgccgttttgcttaataaaccgttgtatgacaagatcgtgctgacttccctggccgtttcatctccggaggaaatgatgttgacgcgctctcccatatagcgctgaatcggctcttttaaaatcggataatgcgtacatccgagaatcagcgtatcgattgatgaatctctgagcgggtgcagtgacgtcctgacgatttcatcagccgtctcatccaaaaatttgccgctttccacaaacgggacaaacattgggcaagccagattttccaccgttaaatctccgttcaacgaaagaagcgcttcttcgtatgcgccgcttttgatcgtgttttccgttccgattacgccgattcgctggttttccgtcactttaatcgcggttctggctccgggctgcaccacgccgatgacgggtatcgcaacttccctgctgatttcctctagcgcgatggccgttgctgtattgcaggcgatcacgagcattttaatatggtggcgggataacagataatttgtcatttcccatgtatatgacaggacttcttttctgtccctcggtccgtatggacaccttttcgtgtctccaagatatataattttttctttcggcagctgcctcatgatttcttttgcaacggttaaaccgccgactcccgaatcaatgactcctatcggttgatccaacaaaatcgcctcattttctgttcatttcctgctgaagtttaattaataatttttcaaacgcggctgtttcttcctcggaaaacgcctctaacatgtcttctaaatagtcctgccttttttgaatgacctcctggatgatccgctctccttccgataaaagatgaatgcggactacgcgcctgtcggacggatctttaacccgttcaacgaggttgtttttctccattcggtcaattaaatccgttgtggtgctgcacgccaggtacatcttttgtgataactcgccgatcgtcatatccccgtattcatacagccattgaagaccgacaaactggggaggggtaatcgtatattgggtgagaatttctcttcctttttgtttaatgatgcccgcaatatggcggagtgatttttcaatatccgctatgtgattcaaagaagcattcgaattcattttctctacctcgctcgactcgttgttttgttttcaaaacacttgagtctattttccttcttttctacacaaattgcaagacttcaacatgaatatacaaattgctcttgaaaaaacaaataaccggttcccttcttgatacaagaaggaacaccggctcaatttagagctctagctcacccattcgaagaagttcaacaacagcttgcgaacggcctttcactcccaatttttgcattgcattggaaatgtgattacgtacagtcttttcacttataaagagctcgcttgcgatttcctttgttgtcttgtcttgaacgagcaattcgaacacttctctttctctttttgttagcagcggctttgattgaaactctttctccttcaagtattgtaaccctccttgctaaggtgagagctgatctgaaacgaatgggtttcgatatagtcgtgatatcatatgaaacatacgcaaggtcggtgacgtttctgacggagaaaagggttccctcaaacacctatttttcaaatcatgacacaggcatcgtttcagggctgaacttctaaggaagacattttaaaatccaggagatcagccgccatctcttcgtaatatatgcgtgcgtcttcttcttctgcacagcgctgatgatttgtgcagccgctttttcgggcgaagccgtccaaaacagatgatcaccttttgcaagagccgtgtccacgaagccgggctgaatttcggtgaccgcaatttcatcgcaaccgagttttttcactttttgacgaagtccttttaaataatttgaaacgaatgcttttgaagcggcgtaggtgacggcccctccgtttcctctcagcgcggcgatggatgaaatgccgactaaatgccctctcccgtttttgataaaatgctccatcaacacgttcgagcaggacacaaatcccgtcacattgacatcgatcgtttccttttctttgctccaatccatttcgctttccaaatatccaacacctgaacagatgaagactgcgtctgccccattcatctcatcaagcagttctttcaacagtataggcgagtgttcgctgtcggctgtatcgatctttttaatgtatgaaggtccagggaggtcgtcgcgcaatttggctagcagctcataccgtcttgcagcaagaccgacctccactcctccggctgacagctgcttggcaagcgcattgccaattccggaactcgcgccgatgattatcgcttttttcattttcctctccctgtcaattatttctcaggaaatgagttattgccaagcagttttgctttttgttcgtctgtccatttcacgggtttacccgtatctttcgcaatttgcaccataaccgccagtcctgtaaagcaaaggccgccttccccatttttcgctgcgtaatggagggtgagcgaggcgttgccgacagatgctgttttgacgccgatttttaaacgttcatgaagcatgacctgctgaaaatagtcgcattgctggctcgccacgacgggaatggccgcgctcttcccgtctgaaaggcggtccatgacgcccaggtgcttgaaataggaaatcctcgcttcttcgaagtagacaaacggtgtgacattgttcatatgaccgaacatgtccgtttctgaaaaacggacggaaacttcatcaaaaaaagaaaatgactgacaccatgtgtcaaacggttcttcgatatatcccggcaatttcaatgttttcatcccctttgatcatgaaaacacctcttcggtttgaagaggtgcgttttttcgtgttattccgtgttgtcgcttccgaagaagtttttaaacgcctgaacggtcgtatccctgtttaatgcagcgattgaggttgtgagcgggatgcctttcggacacgactgcacgcagttttgcgagttgccgcattcggccagtccgccgtctcccataatcgcttcaagccgttcagatttgttcatcgctcccgtcggatgggtgttgaataagcgaacttgcgagagcggtgcaggtcccataaagtttgttttatcgttcacgttcggacaagcttcaagacacacgccgcaagtcatgcattttgacagctcataagcccactgacgtcttctttcaggcattctcggtcccggtccgagatcatatgtgccgtcgatcggcacccatgctttgactttctttaacgaatcaaacatgcggctccgatccacttgaaggtcgcggacaaccgggaatgttttcatcggttcaaggcggatcggctgctcaagctggtcgatcagcgctgtacaggactgtctcggcttgccgttgatcaccatggagcaagcgccgcacacttcctcgagacagttcatatcccaagcaatcggcgacgttttttctccctttgcattcaccgggttccttctgatttccatcaaagcggaaatcacgttcatattcggacggtatggaatttcaaactcttcctggtaaggattagaatccgatgtatcctgacgagtgatgataaacttgattgtcttattttcactcatgatttcgccacctttttcttcgagtaatcccgtttacgcggtgcgattaatgaaacatcgacatcctcataatggaatttcggggcttcaaaatcgcctgcatgtttcgccattgttgttttcagccattcctcgtcattacgttcagggaaatccggtttataatgggcgccgcggctctcattccggttgtatgcaccgagcgtgatcacccgtgccaattgcagcatgttgtgcagctggcgcgtgaatacggcgccctggttgctccattttgccgtatcgttgatattgatgtttcggtagcgctcggcaagctcttggattttttcatccgttttcagcagcttgtcattgtagcgcacgaccgtcacgttgtctgtcatccattcgccgagctctttatgaaggacataagcattttcattgccgtccattttcattatgtcagcccacttttcttcttcctttttgacgtatgcatcgaaaacggaagaagacagatcttctgcggatgtttcgagaccttgaatgtattcaacggctttcggacctgccaccatgccgccgtaaatggctgacaagagcgagttcgctcccaggcggtttccgccgtgcatcgaatagtcgcattctcccgcggcaaacagtccaggaatgttggtcatctgatcgtagtcgacccaaagtccgcccattgagtagtgaaccgcagggaagattttcatcggcagcttgcgcggatcgtcacccatgaatttttcatagatttcaatgattccgcccagcttgatgtccaattccttcggatctttgtgggaaagatcgagataaaccatgttttcgccgttgatgccgagcttttgtctgacgcacacatcaaatatttcacgcgtcgcaatatcacgcggcacaaggtttccatatgccggatatttctcttcgaggaaataccaaggcttgccgtctttatacgtccagactcgtccgccttcaccgcgcgccgattcgctcatcagccgcagcttgtcgtctccaggaatggcggtcggatggatctggatgaactctccgttcgcatagtaagcaccctgctggtaaacgatcgaagcggctgatccggtattgatcatcgagttcgtcgattttccgaagatgatgcccggccccccggtcgccatgatgactgcgtccgaacggaacgactcgatttccatcgtcgttaagttttgggcgacgatgcccctgcacgtattgtcatcatcaagaacggctccgagaaactcccagccttcatatttcgaaacgagcccttcaacttcgaagcggcgaacctgctcatccagcgcgtacaagagctgctgtccggtcgtcgcccccgcatatgccgttctgtgatgctgggttcctccgaagcgccggaagtcaagcagcccttcaggcgttctgttaaacatgacgcccatgcggtcaagcaaatgaatgatcgacggcgccgcttcacacatcgctttgaccggcggctgattcgccagaaagtcgcctccgtacaccgtgtcgtcaaaatgctcccatggggagtctccttcaccttttgtattgaccgctccgttgattccgccctgcgcacatacggaatgtgagcgcttaacgggaacgatcgaaaatagttttacatttgttcctgcttccgcagctttaatggtcgccatcagacccgctagtcctccgccgacaacgatgatgcttgaattgctcatgcctgccccactccctctagtaatctagttcttttacacaaatgccaaaatcgctctcagccctacataggacagcacaacaaagactcccattgtcacaaacgtggcgattcgctgtgagcgaggagaaacagtgattccccaagtgacagcaaacgaccataaaccgtttgaaaagtggaagattgttgagaggacacctacaatgtaaaagccgagcatgatcggggagctcaaaatatcagccatcatgtcaaagttcacctctgcccccatttgggcggcaatccgtgtttcccacacgtgccagctgacaaaaatcaaggtaatgattcctgtaatccgctgcagaacgaacatccagtttctaaaaaagccgaatctgttcgcattgtttttcgctgtaaaagctatgtatactccataaacagcatgataaatcagcggaaggaaaatcacgaagatttccaaagcgtacctgaacggcaggttttccataaagtgagcggcgttattaaacgcctcttctccgcttgccgcaaaatggttgacaaccaaatgctggattaaaaatatgcccaccggtatgacgccaagcaaagaatgcagtcttcgataaacaaactctctgttcccggccattgctttaccccctagttgaaaagtgcagtaaaaatgaaaggtctcctatcccccgtcctgtttcaaatatcgcactttgttaagtttttatgacaatttcattttactcctatgagaaataggcgtcaagaaaacgcgtacataaattgaaattttctaaaatttaatcatatttttgaaaattttattttatcaaaatataaatatatcagatttttttcttcctaaatgcatgtctccgctgtaatctttcaccccatttaagctataataaacggagaaaagaggggagacattggatatgaataaatatgaagcaaacttagcgcaattaaaagagctggaagtctccgcatatggctatgagttgatcagggaagtgctgcttcccgatatgctgggacaagactacgcagatatgatgtactgggcgggaaaaaagctcgcccgcaagttcccgcttgaatcccgggaggatcttcccgctttctttcaggatgcaggctggggaacgcttgcgatcgtccattcaaaaaaacaggagcttgagtttgaactcgaaggcccgctggtttcaaaccgcctcaagtatcaaaaggagccctgctttcagcttgaagccgggtttatcgccgagcaaatccagctgatgaacgaacaaattgccgaatcttatgaacaggtgaaaaaaagagccggaaaagtggttttaacggtgaaatgggatttgaaagacccggcataactatgcaaaaaggcggagactgcaaaagtcccgcctttttctttttaaatgactgctgtctgcttcgacagttcaaaagcatcatgcagcgcttcaacggctttcaccatatcgccttcgttgacgacagtcgaaactttgatttcggatgtgctgaccattttgacctggatgtttttttccgccagcacagcgaacatttccgctgctactcccgggttggagatcatgccagaaccgacgatcgacactttggcaagcctgttttccgtttcaatctgttcatagtcgagcgcgtctttgtattcttctagaacttcaaccgtccgttttaagtcttccgttttcactgagaaagaaatcgacgttttgcttgtgcctgtcaccgattgaatgatgatgtcaacgttgatgttctgtttggcgagcgttgtaaaaatcgttgacagcgtcgtcaggccgctcgccaggccgcatacggtcacgcgtgtgatctgatcttcaaatgcaatgcctcttacgattaaattctgttccattgatgattcctcctcgattaatgtgccggcttctttttcggtgcttgaacggacttccaaaggcacctggtagtttttcgcaaattcaacagctctcggatgaaggacgcctgctccaagattggcaagctccagcatttcatcgtaggagattccggccagcttccgcgctgttttcacatagcggggatccgtcgtgaaaacccccggcacatcggtgtaaatgtcgcatttatcagctttcagggctgctgcgagggcaacggctgtcgtatctgatccgcctctgccgagcgttgtgatttcgccttccgctgtgacgccctggaatccggcgacaacggcgattttcccttcattcaggcgctctttcagcttggctgtatcaatgttcgtaattcttgcgttgccgtgaatattttcggtttcgatgccggcctgccagcctgtataggaaaccgcatcataccccttgttctgcaaagccattgtcaacagcgaaatcgtcacctgctctcctgttgtcagcagcatgtccatttccctgctgctcggctgctcggtgatttccttggcaagcgcgacgagggagtccgtcgatttgcccatcgccgaaacgacgacgacaacatcatgaccgcgctgtttttcttcgatgacgcggtttgcgacattcaatattttttccactgaccctacggaagttccgccaaatttttggacgatgagacccatcaaataccaccctttttgttttcgttcgtgtttgtttatgtatgaagaggaaagcttgaccggcggcctgtacggttttttttgcacaaaaaaagcaacgagagaattccctcattgctttaaccaacaaaaatgccgatgatcttaaacaacgagatagctctccaagaaatgatttcttgacagcctcacatttattcaatgtaaagccagcaggaaaaacgagtggatttttccccgcttcggcgacgctcccctttcggctttcttcatcggaatccatcttcctcatcaagcctactcttgaagttcgcacctctatcttcaccatatcacacgatcttattatgaaattagtacaaattctatcagattctttttaaaagttcaacattattttttcaatgcctcttcgatcagctgcgccgttttcagaggtatgccgagcttgcggatatcttcggcgctcgcttccttcattttcttaacggaaccgaaatgttttaacagcagttttttccgctgttcgccgacgcccggtatgccgtccagcaccgattgaaatgcgctttttcccctgagctgcctgtggaagctgatcgcaaacctgtgcacttcgtcctgaatgcgctgaagcaggtaaaattcctggctgttccgctcaagctggacgatctcaaggggatcgccgatcaaaaggttggatgttctgtgcttatcgtctttcaccagaccggcaacagggacatcgagacccagttcattttccagaacgtcaagggcggcagacacctgcccctttccgccgtcgatcaaaattaaatcaggcagcggcagattctctttcagcacccttgtatatcttcttctgatgacttcgcgcattgatccgtagtcgtcaggaccttcaaccgtcttgatcttatatttgcggtactcttttttatgcggttttccatcgagaaatacaaccatggccgaaacagggtccgttccttgaatatttgagttatcaaacgcttcaattctgtatggcgtgtagatgtccagcgcttttccgagcttttcaatcgcgccgatcgtccgctcttcatcccgttcaatgagcgaaaacttctccttcaaagcgagctttgcatttttatgggcaaggagcagcaggtcttttttcgctcctcttttcggctggcgcacgttcacgtccaaaagctcctcaatcatgtccttgtcgacgctgtcaggcaccaaaatttccttcggaagaaaatggttgtttttggagtaaaattgcccgatgaatgtcagaaattcctcgtctgcttccctgtataaaggaaacatgctgacatctctttcaatcaatttgccctgcctgatgaagaagacctggacgcacatccagcccttgtcatacgaataggcaaatacatcgcggtcaaccatgtcattcagcatcattttctgtttttccatcgttgactcgatatgggcaatttgatcgcggaattctttcgcccgttcaaactgcaggttttccgaggcttcgagcatttttgcttcaagctctttcttcacttcattgtagccgccttttaaaaagcgggtaatttcttctgtgagctgtctgtttgtctcttcagacacatcatatacgcatggcgccagacattgtccgagatgatagtacaaacagacgcggtcaggcagcttggcgcactttctgagcggatagaggcggtccagcagcttttttgtttccctcgcagcctggacattggggtacggcccgaaatagcggcctttgtcttttttgaccttccttgtgacaatcagcttcggatgccgctcgttcgtgattttaatgaacgggtagcttttatcatctttaagcatcacgttatatttcgggtcgtactttttgattaaattcatttcaagaatgagcgcttcgatgttcgaggatgtgacaatgtattcgaagtcttcaatttcactgacaagacgctgtgttttggcatcatgggacccgctgaaataggagcggaccctgttttttaagattttcgctttcccgacgtagatgacggtatcctgcctgtctttcatcaagtagcagccaggctgatccggaagaagggccagcttttctttgatttttttgttcatcaaaaatccttccttatttcggcgtttttccttcatttaagtttaccatgaccgaccgtacgttcgccacaaatggagaaagaagatgacttgtaagaaaaaagcgatccctttggaatcgcctttttcacaggtttctattttacaaatgtttgttgaccagttcttcaagcgcttctttcggtttaaagccgacagatgtttcgaccacttcgccgtcttttagtacgaggagagtcgggatgctcatcacgccgtatttgccggcagtttcttggttttcgtcaacatcgatttttacgattttcagtttgtctcccatttcttgatcaagctcttcaagtaccggcgcgatcattttacaaggtccgcaccaaggagcccaaaagtcggcaagaactacgccttcgcttgtttcagatgagaatgtttgatcagttgcttttacgatagccattctttcattcctccaattgtgaaattatgctttttagtatagcatctccctttggttcacgctaacataatgcttgattatacgtttccctatctgcacagttttacacatcgggattttagcctttctgaaaatgtccatatcccatgttattttgcagaaggcggaaatgtgcctatgtcaaaagccggccatttcaggccggcttttgatcatgtgctgacgctcagctttttaaattcctccgtgagcagcggaacgatttcaaataagtcgccgacgatcccgtagtcggcaattttaaatatatcagcttccggatctttgttgatggcaacgatgattttgctgtttgacatccctgcgaggtgctgaatcgctcctgaaatgccgcaggcgatatataagtcaggtgtcacaactttgccggtctggccgatttgaagcgaatagtcgcagtagtctgcgtcacaggctccccttgaagcgccgaccgccccgcccaatacatcggcgagcttctgcagcggtttaaagccttcctcgcttttgacgccgcgaccgccggctacgataattttcgcttcagacaaatcgacgccttcggacgtttttttgacaatatccttgatgaccgttctgatgtcccgaatatctgcttcgatgctttcgaccgctcctgtccgcgtctcatctttgtcaagcggggcgatattattcggtctgatcgttgcaaaaatcgtttcatcttcggaaatgatccgttcaaacgctttgcccgagtaaatcggccttgtaaacacgatgttgccgccggccacttcgacatcgacggcatccgatatcagccctgttcccatacgggctgaaagcttcggcgacaagtcttttcccattgacgtatgtccgaaaatgatgacgtccggattctcgcgttctatgatcggcaacaaggcttgaacatagccgtcagacgtatagtttttcaagagcgggttttcggctgtaagcactctgtcagcgccgtaatggatcagttctgccgcatgacttgaaacgctttcaccgaacagtacgccgatcacctctcccccttcggcaaccgtttttcctgcggctatcgcttcgaaagtcacattcctcaacgaaccgtctctgaactctcccaatacgataacttttttgctcatgtccatttccccctgtattttaatgaccgtgttatttctcccttcggcttcatacgacctttgcttcgcttctcagcagtgatacaagttctgccgcctgctgctccggctccccttcaaggattttcccggcttcttttttcggaggcaggaaccgttcgatcgtttttgttttcgcagccacgtcttcttcgtcgatgtcgagatcatcaagctcaagctcctcgagaggctttttctttgccttcatgattcccggaagagacggataacgcggctcgttcaacccctgctgtgcagtcgctacgattggaagcgatgtttggatcacttcaagatcgccctcggcgtcgcgttccgcttcaacatctccgccgtttaccgtcagctttgtaatcgtcgtaatacaaggaatgcccagcagttcggccaaacgaggcgcaacctgtcccgatcccccgtcgatcgccacattcccgccgagtataatgtcgtactcgcggtctttcaaatagttgtaaaggatggctgaagccgtatattggtccgcttcttccacgtcgtcttcaatgttgatcagaacggctttgtcgcaccccatcgccagagccgtcctgagttctttttcagcttcttcctcgccgactgtcacgaccgtaatttcaccgccgtgcttctctttcaactggagcgcttcttcaatggcgtactcatcgtacggattgatgatgaattccgctccgtccgtgttgatttccccttgttcgatctgaattttctcctctgtatcaaacgtgcgcttcattaagacataaatgttcatgttctgttcatcccctttgttttcacgtttgttatttccctttaaaatgcggcttccgcttttcaagaaatgcctgaatcccttccttcgcatcctcggattggaacacttcgccgaagtatttcccttctagcttgaggcctccttcatacgaatacactttgctcgaattcaggagttcaatgacataagccatcgtctgcggacttttttcagcgaatttttgtgcgagctcttttgccttttgcagcacttcttcttcattcgccgccaaaatcgtgacaagaccgtattcaaaagcttccttgccggatatcggctctgatgtcccgatcatttcaagcgctttggcggtgcccacatacttgggaaggcgctgcgttcccgcaaagccgggaatgattccgagattcagttcgggaaggccgagctttgcgctttcctcggcaatccggatgtggcatgccatcgctagctcaagaccgcctccaagagcggccccgtgaatcgcggcgatcaccggttttggaaaagattctactttttcgaaaatctgctggcccttatcagccaaatttgcataatcagacccgtccatcaatgatgtaaactctttaatatcagcgcctgccgagaaaaatcttccttccccgtgaataacgacgcttctgacatcctgacgttctgaaagttcatcaaggcatgcagaaagatcttcaagcacttgcgtcgatagcgcatttgccggcgggtgctgaatcgtaatcgtcgcaacatggccgtctacggcgtatgataatgctgccatttttattcctcctccttcgtcttttggctgctgaacccgtggatcagcaattcatgaatgctgtctgccaggtttgggagatcgtatttttgatcattcatcacccaggttgtaaccgtctcatccaccgtaccgaaaatcatctgcttcgcaaggcggacgtcaagcgtgcttttaaattctccagcttcttttccttcggtgatgatgtcttccaggatcgttaagtaccctttgagaatctcattgattttcagcctcagctcaagattcgactgcctcagctcaagctgggtgacaatcgcgaggtggcgatcgctgctgagcagttcaaagtgctttttgatgaacagcgaaagcttttctgtcgccgaatttttcgctgtcatttcttcgctcatctgctcgataaactgtcccattttctctttgaataatgagatgagaatgtcttctttgtttttaaaataaagataaatggtgccgtccgccaccccggcctgcttggcgatttttgaaacctgcgcctgatggtatccgttttctgcaatcacaatgacagctgcgtcgataatctgcatatactttggtctcttttgtttcaattggcttcgttcctttcaaattaatgaatgaatactcattcatgagttaatcgtaaataaaaatggacgctttgtcaagaagctaaaagtaaatcgcatcacaaaagcatgccgtcaaaatcgacggcagactttgctttttcagacgccggtcttttcctcttgaacgagcgctcttcttaaaatctttccgaccgccgttttcggaagttcgtccctgaactcgtatacttttggcactttataaggagcgagacgcgatctggcatattcgtccaattccttctccgttattgtaacatgatctttcagcacaacaaaagccttaaccgtttcccccctgtattcatcagggatgccggcaacgaccgcctcctgaactgcttcatgctcgtagagcacttcttcgatttcgcgcgggtagatgttgtatcccccggcaatgatcacgtcttttttgcggtcgacgatataaaagaagccgtctttatccatgtagccgatgtctccggtaaaaaaccagccgtcccttagactctgagcggtttcttcatcattgttccagtagcctttcatcacctgcggtcctttgacggcgatttctccatgctcataaggcccgagaaaaccgccggtttcttccgaatagatagcagcgtctgtaccaggccaaggacacccgatactgcccgctttattcaaatcccaaataaaattggcgtgagtgaccggcgacgtttcagacattccataaccttcgacaagccttccgcccgtcaccttttcaaactgctgtttgacttcaacaggaagcgccgcagatccgctcaaacagctcttaatcgatgacagatcgtattggtgaaggtcgggatggttcaacagggcgatataaatcgtcggcgcccccggaaatatcgtcggcttttctttatcgatcgttttcagcgctgcgcgcgcgtcaaatctcggcagcaggatcatttcatacccctgcctgatcgtgaaattcaagacggccgtcattccgtagacgtgaaaaaacggaacgatccccagcaccttctcctcccctttattcaattgataaaaccaggcggcgcacatctccatgttggctagtatgttgcggtggctgagcatgacgccttttggcgtgcctgtcgttcctccggtatactgcaggacggcaatgtcgtgggccggatcaatttcaataccgggcggtccgcttggaacggggcgtttcatgatggtgcggaaaaggtgggtcgtctcattttcattgatctcaacggacatttgattctcttttttttgaacgatcgggtacagcagatttttagggaaaggcaggtaatcttttatgcttgtcgcaatgatgtgcctaatgcttgttagcgctttcattttatatgccgccgggtacagcatgtcgagcgtaatgatgatggttgccccgctgtcatgaagcagatgttcaagctccctttccgtatacagcggatttgtctggacgacgatgccgccggagaaaagaacgccgtaatacgcgataaccgcctgcgggcagttcggcagcatgatcgatactctgtctcctttttgaatgccgagcgacagcaggtaatctgccatttttaaagcatcctcgtaaacttcccggtacgaacgtttttttcctagaaaatgaatcgctgttttttctgaaaactgctgggcggattgttgcaggatggaatggagtgtttgatcttcaaattgcagctcgtgaggaatttgttcgggataatgacgcagccacggtttttcagtcggcataagctccccccttttaaacaatatattcttgatttgagtatatcaaaacaatattcagaaagtaatgatattttttcatttttaaaaaggcgccccttttttaggacacctttttcaagcataaaagatcatataaatcaggccgataaccacaaataccccagctgtaaaaaacaggactttcgctaatttctccatgttgatcccctttagatacccgaagccacgacaaatgacaggcctactgaaatgacgaatgaaatgaagccgactgcgcggttgtcgttttcaatctccttgtcaattttaaagcgcggcgtcagaaattcaaaaatgaagtagccgatcaaaagcaggataaaaccgaacagcccccaccccatcatttgcagcagggaattatgctggctgatcgatttttgcagcacgttggcgatgcctaaaatttttccgcctgttgccatcgcaaccgccatgtttcctttttgaatctcctcccaatttttatacgtggtgacgagttcaaacacagataaaaatatcacaagacacaaaacggaaacactgtagtacgcggcgatttccacaaggttgttctcccaaaactctttcatccttttagactccctttattattttaattcgacaatggtgactcctgatcctccctctcccgcttcgccgaaccgggagtttttcacattgcggtgggatttcaataggtcctggacgccttttcggagggcgccggttccttttccgtgaatgatcgagactctcggatagcccgcaagcaccgcatcatccaagtatttttcaacccggtgaagcgcattttcaaaccgctcccccctaaggtcgagttcgagcgagacgtgataatctttccctttgacggcggcgatcgttttttgtttctcgggttcgggtgccgatttcaggaattccagatccttttccttgaccttcattttcaggatgccgatttgcacattccattcggccgcacccgttttttcgagcagcgtccctttttggccaaaggttaaaactttgacttcatcgcccggttttaattcgcgcttgtccgtttttttctgagccggctttttcgctttttcaaacgaaggcacggcttcttcaaggcgctttttcgcctcgatcagctcatggtctttaaatgctttatggtcttctttgatcatgcggagcgactggatgatgtcgtctgcttctttcatcgctgctttgactttttcagccgctttttgctccgcttcttcgtagagcttgtcttttttctcctgccattcgctgatctgctgctgcaggtcgcggtgaagggcttcagcttccgcgcggatggcttcggtctccttgagctccgcttctgcgcgctttttgctgtcttccagcgatgcgatcatcgtatcaacttcattatgttcggccgtcatctccgcttttgcgcggccgatcaggtaatcaggcagcccgaggcgcttcgagatttcgaacgcattgcttcggccgggcactccaattaaaagcttgtatgtcggtgatagtgtatcgatatcaaattcgacgcttgcattaatgacattttcgcgattgtagccgtatgccttcagctccgggtaatgggtcgtggcaatgacgcgtgcgcctgtctggcacacctcatcaaggatgctgatcgcaagggccgcgccttcctgcgggtctgttccggcaccgagctcgtcaaaaagcacaaggctgttttccgtcatgtctttcaaaatatcgacgatgttgaccatatgcgacgagaacgtacttaagctttgttcgattgactgttcatcgccgatatcggcaaatacttgatcaaatacggcggtctctgatccttcttccgccggtacgtgcaatcccgactgcgccatcatggtcaaaagcccgagcgttttgagcgtcaccgttttcccccccgtgttcgggcccgtgatgacaattgtcgtatactctccgccgagctcaatatcattcggaacgacctcatccaggggcaaaagcgggtggcgggcttgaatcaggcggacatagccgtcagcgttgacagccggtttaaccgcttttgtcgcttttgcatattttgcttttgcaaaaataaagtccagcgtctgaagcactttgacatcgtgaaagagctcatttgtgtgctctgccgtcttttctgtcaggacgcgcaaaatccgttcaatctcctgtttttcgtttacttttgcctggcgaagcgcattgttcatatcgacaatcgcctgaggctcgataaacaatgtcgcaccggaagaagactgatcgtgcacgattcctccgtagcttgatctgtactcctgtttgacagggatgacgaagcggtcgttgcgaatcgtgatgatcgtatccgacagcattttttgcgcagatgaagaacgcagcatcgattccagccggtccctgattcttgattcaagcgtccgcagctgggtcctgattccccttaacgtctctgatgcatgatcaagcacttccccatgatcatcgatgcacgaattgatgtccctttccaattcggaaagcggtatgagcttttctgcatattgatgaagataaggaatctcaaccccgtcttcgaacaggccttcaagaaagtgcttcatctgttttgctgcgtatagcagacccgatatttcagtcaattccgccgggcttaaaatgctgccgatttctgcccttcttaacgcttttctaatgtccgtaaggccgccgaaaggggcgcttccttttaaacgcaggacggttcctgcttcatcgacttcttcctgcagctttttaacttcttcgagcgaacgggaaggtttgagttccaaaagcatttccttccccaaagaagatgccgcatgctctgtgagctgttcttttactttatgaaattcaagtgctgatagcgctttttgctgcaacgtccattaaacctccttaagatcgatggcgcgacaaaaatgcctggacttcttcaaaggagcgggtgtttaatacattggcctttggcgtccatccttttctcgctgccgtaacgcccgttttcatatcatcaagcatcgctgtgttgtgggcatccgtattaataacgagtgtcactccggcagcattcgctttgatcaagtgctccattctgagatcgagccgcgctggatttgcgttcagctccaatgctgtattcgtttttttcgcaagttcgatcagctggtcaatatcgacttcataccccgcccttcttccgatcagacggccggtcggatgagcgataatgtcaacgtgctgattcagcagcgcggtttcaagccgcttcatgatgacatgctgcggctgtgaaaagcttgaatggatggaagcaatgacaagatccatttccgccagcagctcgtcgtcataatccagtgttccgtcaggcaggatgtccatttccacgcctttaaaaatatgaaaatcggtaaattccttattcagttcatcaatttccttcgcctgcatgcgaaggcgctcaggcgtcaaaccgcctgcgacttttaaatattgggaatggtctgtgatcgccatatagcggtacccttttgccatgcatgcttccgccatttccctgatcgaaaaagcaccgtcgctccaagccgagtgcatgtgaaggtctccttgaatatcctcggcggaaacgagtccgatgtcaacgctgtagtcctcgacttctcttcctgtctcccgcagttcgggcggaataaacggaagcccgaaatgggcgaaaaactctttttcgcttgagaaagttttaatttctccagtttcaacggtttcgacgccgtattcactgattctttcgcctttttctttggcaagctggcgcattttgatattgtggtcttttgatccggtaaaatgatgaagcgtcgttgggaactgttcctctgtcaccagccggaaatccgcactgatttcgtattcaaacgcaaatgtgagagacactttcgtatctcctgcggcaatgacctccttgatgttcgaaagctttaagagcccttcccggacaagttccggatcagtgacagccataatgtaatcgaggtctttcaccgtttctttggcgcggcgcaggcttccggcccgtgaaaacttaatgaggcccgggagcccttcaagctgctcttcgatgatgtcagcgacggccaaagcgaccgcgatcgggtaccgttcagggcgttttcccgcttcacccaaagcctgcaggattttttcctccgtctttttgccgaatccggcaagcccctgaaccttttgctgttcgcaggcctcttttaaagatgccgcatcacagacgccgagctcctgatacagcttggcgatttttttgccgccgagacccggaagcttcaaaagcgggacaagtccttccggaacctcttcctttaatcgttccagcgttccggatgctcccgtgtccatatattccttgatgacagcgtatgtgcctttgccgatcccggacagggacgtcatatcatcgatttccgagaggctccggtcgtcttgttcaagagctgccgcagcctttctgaaagcggagattttaaacgggttgtccccttttagttccatatatatcgcaatcgtttcaagcaatttgatgatatcttttttatgcatgttgttcacctcttgtttcccctcgttcatcctgcttcaatcatacaaatttttggctgatcctacaacaaacaggcatatccgacagcttccggggttctcaagagccccgaaaaaaaacttccctacaaacagagaagtttttacaaagatccgtactgatgcagcagattgtttaacatgtttgataaaaacggtgttttatgaatgatcaaatcagccatgactgaaccggccatcatgctttgcaggacatcaatcggcagaagcgttccgatgaacagaacgacaaacacgaacagatagatttccgcaaaaccgagcacggctccgagtatttggttgatctgtttgagaaccggtatgcttgcgacggcatccaaaaacgatgcggcaactctcaaaaggataatcgtcaggataaagagaatcaaaaacgcaatcatattgtaataagcgccttcaaggcttccgtttacaaacgccagcgcagcctggccgcccgtaaagtcgggagacggaatccagccgagcttaggcgcaaggtcgccgtaataggttgcggccacagcgatcgctgcgataaacgtaaccaaacggataaactggcggataaaccctcttttgagtccaataaacaaaccggacaaaagcaaaatgataatgatgatatctaacatcgtgatgttcaatccttttcttttatttgtccttttaatctctcaagctcttccttaagcttcaaataatcgtgaaccacatttacagccgtcaaaacggccagtttatttatatcaagatacggatttttttcgttgatttctctcattttatcatccacaatcgaggcaacgtgcctcatatggctcttgctctcatcgccgacaattgtgaattgctgaccgtagatgtcaactgttgttttcgttttttgaccatcagacaacgtttctcctccattccaattatgcgagaatcctagtctatatcataacatgtttacagattgaatggaaagacgagccctccgctgttatgatacacttatgaaaacaatgatttagcgtatttaaagctaataaaggagattagaacgtgtcacattctgttttaaaagttcccccgtctgttattgaacggatgcaaagccactacgggcctgacattacttcactttccgtacagggcgcagttttccaagccaaaccccaagggtgcaccattacagcataccggtcggggaaggtgctgttccaaggaaaaaacgcggaaaaggaagcggagcgctggacggcggatgctgaaacaccggctcccaaaaagcccgcatcgaaaaaaagcatcccgtccgtctatcagccgcctgaaggcatcggttccatgtctgtgatcggctccgatgaagtcgggacaggcgattatttcggcccgatcaccgtcgcgtgcgtatacgctgacaaggcgaagcttccgctgttaaaagaactcggtgttaaagactcgaaaaacttaaaagatccgcaaatcgttcagatcgcgcgcgacttaatcaagacagtcccttacagcctgctcgttttaagaaacgaaaagtataatgaaatgcaggaaaaagggatgagccaaggaaaaatgaaagctcttctccacaaccaggcgatcggcaaccttctcaaaaaattggacggaacccggcctgaagcgattttaatcgaccagttcgccgaaccggccgtatacttcaagcatctggcaggcaaaaccgccgtcaaagaacgtacatatttcagcacaaaagcggaaggcatccatctttcagttgcagcagcctcgatcattgcacgctattcatttttaatggaaatggataagctgtcaaaacaagccggcattacgcttccgaaaggagcgggcccgctcgtcgatgaagccggcgccaagctgatcaagaaacacggcgaagacgcattgcgggtattcacaaagctgcattttgccaatacgcagaaggcgaagcggattgcgtcgaaacggtaagcggtgcggactaggctggataagcgggtccgttgcaactagacccgcatatttcactaaaacattaacaataaatgaaaaataaggattgaaaattcaaattaattgtagtatattgaacaaacttagaattgaagccccatatacaggggctttaattgttccaacagaggcaaagcgatatcaagcgctaggctgaattgcttcatgatattgtcttttaatatggcccatattcaattatctcaattttcagcttactgcacaccagatggcttttgaatgtgtactcctttgtttctggatacttctaagatataaggcggggatttggatgaagaaatcaggttcatttggcattcttttaattatttcagctctcataatatcaatgtattttatgttaaatacaaaggctttgatcttcaggatatgacttagccattcatggaatctcgtgatttcaagaactttaatgattgtgttcactttgtacttactttctaaattgggatattttcttctaaataaaaaaggttagcttaatcgagctaatctttaatatatttgctacaccttttttcaagcaaactgaaattcagacaccctgctgaattttgaccggctgtgaaatgtttgaaccttctcttctttatatggcgaaatcattggacctctatggatgattattgcgaatatctccgcattccttctcatacaaatcgacagactcagaaaggaatcaccatgtcaaaaataaaatggatcatcacgctcaccatatgcacagctctggcattttctctctttattttcttcaacaaggcgaactttacagaggccagcgaaaataaagaaaccgggcttttctttgcccgaaactacatcagccatatgatggaaaacgagacgatgtcgtttaacattttcggcctgcaaaaagcaaacgccggcgttcctctaagcggtgagacggttacgtcgctcgcttttgataacaatcatatacaaatcagcgattacaaggttgaaacagggattcgccataaaggctatacgctcgtcaacatcatcgtagatgtccgggtctcaagcgataaaccgtaaaaagcggatcagctgctgatatcttttaacggacgtgatagagaagcatttcaaatcggaaagatcacccttcaaaaccatcacaatgttcgaagcggcgatctgtcgcctgccggtcaatatactgcaggatatccaaaaccgtccttggacgttcggctgaaaaacaatctcgcaaaagatatttcccttgaaaagatcaccgatctaaacggcgtcatggcgtatacatttgacaaggggaccgccattcaagcgaaacaaagcaaacacatcgtcgtcccgtcttttcatatgacaggcgaatatgatttttatacggtcacccctgttttacgttatactgcagcagggaagcggaatcaatacagcatgcccggtgtactgtacggagctttagactccgatgaagagaaaatcgaacggatgctgaagcgtcaatagcttatgaccatgttgaagataaaaaaccggttcccgaatgatcgggtaccggtttttctttatcctctcaatacagcctgatacgtatcctcaagtgccttcagcacttggtcgtgaacttttgtcacttcttccttggctaggattttaatatgcgggctataaatgcctttttccagaattcttgagaattgagtcatgaatttcgttctatacagaggagatatcgccccccctaacaagactatattaaactactaacattctatctaaacacagtatattcgatatattcaaccaataaaaataagaaaatgagattgtaattcctttctaaaaagaaacttttgatttatatatcaataaaaatagaatagataatccgttatatttactaaaataaccataagtgtaataatagccctacaagagacaaagggggtgaaaatatgacaatttctaaaaaacaacgcatcaacgcttctttagccttaggtctactttttacacttacatttttcacaatgttatacgcaacaacagcaccagttttaccgattgcagacctagcagcaacctatcctcagattccgggatgggctcttacttcaattagtgccatcttaaatgctgctggcactgttggagcaattgcagcggttctagggacttttggactcggagcgattgcatccctagttttttcctatgcaaaaaaatacggaattagatatgctatcgcttactaataagttttaatttaggaaagggtattatttaaaatgccctttcctccacatttaagtcaggatggttttcaatgaataataaatacttaatttattcaaaaattcttttaaccaacgacattcgaaaatttaatactaaaagcaaatggcttgcattattcgtattgatattgtcattcgttgttttccctttaataattggcagctttgctgggtacatcattaaaaatctagtcatcattcatctttctttttttctgtttatccttactgtaaatattgataaaagtattttcagagttatgttttcctccgacaaaaaacaaatggccattctgggaatcaaattggatcaatttatattaggaaaagatattagtaaattttatagttcatttttatctttaatatctttttatgttggttcatcgattgtatattatctcattcatcagtctttggaagaagtcttcgcgattgctgtgattggtttattgtccgctatactaggatatttgcttagacttcattttataaggctattagtattgcctaaattcataaatgtctcaagcattattggctttttcacaaatggaattttaattctttggatcttttttatactcaaatataatttgttatttctaaacatcaataatatgcgaattttttcaatatctataccaataatggtatctttaacaatcctgttaattatagtgtggtataaaagtttaagaaacctttccatttttaatgatcatttaaatagcaagactgatacaaatttgaagaagtctagagagagcagaagccttctatattacgagctgatccttctatataggaacccgcctgtaaggtggtcggttttattatttattttaagtttatcagcaggtttactaacaatcattttgtatggttttaacactgatcgatttgcagacactggaatttccaacgaattcagctttatgttcagcgtgctgttcccgttagtctttatctctatcatgattcaatcattggtttcttttgatattgatggtcttattatacctttgaatcagcacaagccaaactttattaaaaacaaaataaaagcaaaaaccaaaatctctgtcttagcacatgtgttatttgttttaatctatgctgcgatttcaaatttttatataaaaccggatcattttattgcattatccattatcttattgatgatagctgttactttggggttaagctgtctcacttcaactatattgtttccatattttaaatgggattacatttatcaagttcccagtactttaagcaaaatctttcttaatttagtatttggattactaatagggttagccattgtttcaacttacaacaaagttttgtatgttgttatttttatcactttgttatgtatcataacgctactgcactccataaacaagcaaatatggaaatcaacaatcaacaaaaattacatatcaataaaatctttattcgagtgagtgattatatgcttaaactgcaaaatatatcaaaagaatatcctcaatccaattttagcatgaagaatttagaattcgcttgcgggcgaaatcagattattggattgctcggtaaaaacggagcaggaaaaacgaccctattagaaattattgcaggcctcattcctccggatagcggtgaggtagtcgttgatggacatcttaccaattatttagagaaaatcggatacctagaagacgatccaaaattatttgagaatttaacgtgttatgaattaatcaagtaccaatctttattaattgaaaaaccattatcccaagaacaaatcattgaaaccttagacatgttcagtctaaaagaacaaaaagaccaaatggcatcttcgctatcaagaggaatgcgtcaaagaatgtcttttattctttccactttgcatcaacctgatgttatcttgcttgatgagccttttacaggacttgatccaaaaaacatggcggatatgaaaaagattttaattaatattagaaatcaaaatagaattattattttatccacgcatatcttacagtttgcagcagatctttgtgatgagatattatttattaataacggaaatattatccacactgaaaaaaaattagccggggagacatttaatgaagccagccttgaaaaaaaattccttgaatacctatgctaaatactctattttgttcattattatttttggtttcggtttttctcttagcttttttgtatttcaagaaatacacgagacttactatgatagctttaaaatatccaacgctttagagatttttacaaataacttaattgtaggactaactattttctttcttggattaatcagtgttggtttcctatctagtgtagtagtgtttttaaacggttatttctcaggggcaattttcttttcatatgagaagtctttaggtttttggaaatcactacaatatctcttatttcacggcccctttgaaatccttgcccttcttgctttttatgtaatatctcttgatatttcttcccgttttttaagatttctaaaaaagtctgaaataaacctaatgattaagccgaaagtaaaagagtacacaataataatgataagtgcagtaggccttctaatcttagcatctattgtcgaatactacgtaatattactaaaataaggagttcaatatgaagaagactaaattcaacttaatatgtatttgtctattatctggagctgcagccttatgtgtttccattttaaaaatgaatgagatcgatgctagcttacatgaattaaacgaagatgaatatggaaatcttattactatcagtaaatggattggcattacaatagcagtaattggcgaagcgataaaaccccttcttgagcttttatttttcactttaatcatttggctcgctattatgatttttggagcaaaggattcctttaaaaacattttttcaaaaggtgttctttcctactatttcaatcttgtaggcagtgtcttagttattgtcttttatctatttggcttaaaagatgctgaaagtcttttttctattccttttttaagaaatttaaacattttttctttaatttcgttatttttttggtgctatttatgtctagaaaagaaagaaaactcactaaaaattaaatactctttttcttttttcatattgtttttattttctattgccatatctattttctccgatattcttgcatagattaccttcgtatagactcattaaataacatatgagaattcgatacaacttaattcaaaatattttacataaatattcttgccatcctaaaataattaaaacttacaataggccgacaatttttccaatgcaaaaaaaccggttcccaaatgatcggggaccggtttttctttatcctctcaatacagcctgatatttatcttccagcgctttcagcacttggtcgtggacttttgtcacttcttcttctgtcaatgtctgttcaggattcaaatattgcaggctgaaggcgacggacttcttgccttcttccatgtgctcgccttcatagacgtcaaagacatggacttctttcagccatttgccgcctgctgttttgatgacgtcctcaagctggccggccgttgtttgtttgtctacaacaagcgcgatgtcccttgtaacagaaggatacttcggaattggtgtatacgtgatctccggtacatccaatcggaggagctcgtgcaggtccagttcaaacacatacgtgtcgctcaggtccagctctttttcaactgacggatgcagctggccgatgaagccgactaatgagccgttgtgcaaaatattggctgtccgcccaggatgaagctcttttctttcagattgagcgaattcgatgccttcggtgattccgagcttttccaacagaccttcgacgatgccttttacgacgaagaaatcaaccggctttttctcgccctgccagaggtttttgtgccacaggcctgtcacggctccggcgacgtgttctttttcgaccggtttcgtatgttcttcggctttcaagaaaacagaaccgatttcataaaaagcagctgaatcggcctgccttgccaagttgtatgcaaccgaatcgagcagattagggagcaggctgtgcctcagcacgcttctttcctcgctcatcggcagtgaaaggatcgttttaaacgatttttccaatgcgtaagccgtcgcttttttatcgtttgttaatgagtatgtgatcgcctgggaaagccctgctccttccaggaagcgtcttacttttctgcgcttgtcctgataaggtgtcagtccgcccgcaaagcctgttacttccggcagtgtcgacggaatgttgtcatatccgtacagtcttgcgacctcttcgatcaaatcttcttcaatcgcaatatcgcctcttcttgacggaaccgtcacgaccagttcacgttcagcgtcttcaactgcaaagccgagcctttcaaaaatgttgaccatttcttctttgctgatggacatgccgagaaccttcgtcactttatcaacggaaaggcggatgacattctctttgatgtcaagatggttttcttcgaccgtaccttccaagacggttcctccggcataccggctgatcaaatctgccgcgcgttctgcagcgaggcgcacccgtgcaggatcgatgcctttttcaaagcggacgcttgattcgctgcgaagacctaggtcctttgatgctttgcgaacggtctggccgttgaaatacgccgcttccagcagcactgtcgccgtatcttcgcggacttctgattccgctccgcccattacgcctgcgacagcctgcggagaagagccgtttgtgatgacaaggtgctcaggggtcagcgttctttcttgttcgtcgagcgtcgttatcgtttcgttctcgtacgctttgcggatgacgacctcttttgagccgaagcggtcataatcaaacgcgtggagcggctggccgtattcgagcagcacaaagttcgtaatgtcgacgacattgttgtgcggtctgatgccggcgttgatcagcttcgtctgcatccaaagcggcgacgggccgattttgacgtctttaatgattttcgccgcgtataaaggattggcttctgtatcttcaattttgacggaaatatagtccgccgctttttcggcgcctgcctgataagccgtctcagggagcttgacttcgcggccgagaatcgcagccacttcataggcaacaccgagcatgttcatggcgtcggcgcggtttggcgtcagtcccagttcgagaaccgcatcgtcgagcgccaggctttgaagggcgtccgccccggtttcagcatcgcccgggaaaacgaagatgccttccgcatattctttcggcacaagcttgccttgaatgccaagctcctgcaaagagcagatcatgccgttagacgcttccccgcggagcttagcctttttgattttaaaatcgccgggcaataccgcgccaaccgtggcgacggctactttttgccctttgtccacattcggagccccgcagatgatctggacaggctcttcttcgccgatatcgacgaggcatttgtttaatttgtcggcgttcggatgctgttcgcgctccagcacatgtccaatgacaacacctttaattccttctcccttatattcgatgccttccacttcaattccgcttcttgtaatcttttcagcgagaatctcgggagtcatcccgtctaaattcacgtattcttgcagccatttatatgaaacaaacatcacgcgtcctcctctttaagcttgtttaaattgagataaaaatctgacatcgttcgtatagaaatgacgaatgtcgtcaatgccgtacttcagcattgcgatccgttcaacgcccatcccaaaagcaaatccctgatattgtttggaatcgaatccggccatttcgagcacgttcggatgcaccattccggcgccgagaatttcgatccagcccgtttgtttacaaacggagcagcctttgcctccgcatttaaagcaggaaacatcgacttcgacagacggctctgtaaacgggaagaagcttggacgcagtctgatttcgcgctcttcgccgaacatctttttcgcgaccgtttccagggttccttttaagtcgctcatgctgatatcacggtcaacgcagagcccttcaatctgcataaactgatgggaatgtgtcgcatcatcgttgtcgcggcggtacactttgccggggcagatgattttgacagggcctttgcctttatgtttttccatcgtgcgcgtctgaacaggagatgtctgtgttctcatcagcgtatcttccgtaatataaaagctgtcttgcatatcccgggccgggtgctctttcggaaggttgagcgcttcgaagttataatagtcggtttccacttcaggcccctcttccaccgaatatcccatgctgataaacaagtcttcgatttcttcaataacgatcgtcagcggatgccgcgctcctgttttcacagggcttcccggaagcgtcacgtcaatcgtctgctctttcagcttccttttcacctcttcttcctcaaggcgggcatttttttcggcgatcgccgcggcgattttctctcttacttcgttcgccaaggcccccattttcggcctttcttcagcggacagctttcccattccccgaagcacttctgtgatcggtcccttttttcccagatacgcaacgcggacatcgttgacttcttttaatgaaccagcggcttccactttttcaaccgcttctttttcaagccgtttcagctcttcctgcatcttaaaaactcctccttttatgtagcaacctgttttttaggcaataaaaaaagccccttttataatgaaagggacgaatcgtggccgtggtaccacccttttttaaaacaaagcaaaaaagctttgctgcttacttcattggcataacggaataaatccggttcacctttacacatccctcgagggacgtggtcccggtgacaactcaagaggtgaagcgtttttccggcctgccataaaaatgcttgcagtctcaggcattttctccctgaatggcggcatgtgaaaaaacggagcctctatcactgtttttaaacatattaaattcattatagtgaattacatgatcctgtgcaaccggttatccgcggagatgataaagaaggaccgcggctgcggccgccacattgagcgactccgcttttccgtagatcggaacgtacagattttggtcggtctgtgcgaggagggccggatcgaccccagatccttcgtttccgatcaatagcgcaaacgactgcgacggctccgcttctctaaatggcacggcaccctgcagcgctgtgccgtaaaccgggacgctttttcccttcagctcttcaatcagctctgaaagctcgcgttttaaaatcgggatgtgaaaatgcgagccttgagccgacctgagcgttttggcattgtaagggtcgacagtcccttgtccgataacaacggcatcgatccccgccgcgtctgccgtccggatgatcgtccctaaattgcccgggtcctgcacagcatcagctagcagcagcttttcgtattgaaaaggtccgctttcgggcattcggcatacagcggcgaccgcctgaggcgtctccgtttcggcaatcgctgaaaaagcatcggcgctcaaaacatagcgggcaacagactcatcaatcatagccgggaagtccgcttcgtctgcgaccatgatttctttcacaacacccggtgtcttcagcgcttcctcaacgagatgctcgccttctattaagaaagtattcgtttttgtccgctctttttttgcatgaagttttttccagtccttcactttttgatttttggctgattcaattcgtttcaaatcgttttgactccttttgtctcgcaatagtcacattatatctcatcaatgatacataataaacccgaaagcgaggcagaatatagaaaaacagatgatgaaatggagtgaaaaatgatggatttgaatttgcgccatgccgttattgccaatgtatcagggaactcgcaagaagagcttgaacatacgatcgtcgatgcgatccaaagcggtgaagaaaaaatgcttccgggattgggtgtgttgttcgaggtcatctggcagcacgcaactgaatcagacaaaaccgaaatgctcgagacattggaacaaggattaaaagcgaaataaaccggcggccaaacggccccggtttatttgatcatccaggtatagaaggctccatccgcaatgccggatcgcgccaaatctccgtccattttttaatggctgcagccatgatcacaagtcccaacacaagcataatgatcgataaaatgccgtttaaaacgctgaaaccggcagcttccgcattaaaataaacgtttttgatcatccagtatcccgcatagttgaccgtcacatacaaataagcgagcggaatgagacatgtcagcatataacgccgtttgtccgcaatttttaaaatgaccgtcgctccgataattaaaccgacggatgccatcagctggttggatacgccaaacagcgcccaaatcgagctgatatcgcctgagtacagcaaatatccccacatgaaacaggcaagggcgctcgctgcgaccgaacccggaagccagtccgtttttttcagcggtttgtacacttccccgaaaaagtcttgaatcaaataacgcgccacccttgtaccggcatcgatcgccgttaaaataaagacagcttcaaacatgatgacaaattggaaaaagtaagaggccaaatggctgaaaaacggaatatccgtgaaaatataagccatgccgacggcaagggtaacagctccgcctgttcttccttcaagatcgagaccgatttcgcggctgagttcaggcagatggacgacattcatgccaagcgtccgaaagacttctggcgaactgttgatggcaaaataatcgcccggctgcaacgccgttgccgcgattaaagccatgatgccgacaagacactcaacgagcatcgctccgaagccgacgaatttcatgtcgctccacttgtcaagcatcttcggcgtcgtgcctgaaccgacaaacgcatggaaaccggaaatcgcaccgcaggcgatcgtaattgaaatgaacggccagaccggaccaggcgaaacaggtccccctccgcccgtgaactcggtaaacgccggaaacggaatcgccggattgacaacgaaaaccccggcaatcaaagcgataaacaccccgattttcataaagctgctcaaataatcgcgcggtgcgagcagcagccatacaggcagcgccgctgcaaaaaatgcatagacaggaagtgcgacagcaagcgttttcgtatcgagcgtcaaggcgtctccaagcggcgtctctgcaatggagggcccgatgaagacaccggccatcagcaaaataaatccgccggtagacgctaattttaagttgcctgtctttttataaaataagccgacccccatcgcgatcggaattgtaatcgcaacggcgaacgtcccccacggattgcgttcaagcgcatgaagcacaaccatcgacagccccgccatcgtgattgtaataataaacagcatcgcaagccccgtgcaaaatcccgcaacaggcccgagctcttctttcgccacttctgaaagcgactttcccttcctccgcatcgacgcaaataaaacaacaatatcatgcacggcgcccccgatgaccgctccgatcaggagccacaacagccccggcaagtagccgaactgcgccgccaagatcggcccgacaagcggccccgcggctgcgatggccgcaaagtggtggccgaaagacacccatttgttcgtcggcacataatctttgccgtctttctgaagatgggcaggagtcggcttgtcgtcatcaaccttcaacactttcaccatcataaatgttccgtacaaacgataggcgatcgccaaaatacagatggaagcgatcacaattgttattgcattcatccaattcctccccccctttgtctcttttttaacatagctcatattttttgtaagcgcaatcatcttttgtgcgttttttcagtcccgataattaaaacatagttgactaataggaataataagaataaaatagacacaagcttcatctgctgccttttttaaggcgtaattggcgggtatcatcggatatccgccttttttctgtcagcataacggaacgataaaaaaatgaacggccatcactagacaaaaagcggcggtccccgcgattcgattgacatttgttttgacaagcgaagctgagaaatggtgggacagcgaaaaaaacaaaatggtgccgatcaagatgacgcccgcctctaaaagtgagtgattaagaaaccggggccggtcaaggatcgccgtgataaacagaagccaaaggtatgctaaaaatgcgtacatcaaaaaacagtacgcagccgaaaaaaacgtcttcataaatcctcttcccgttttaacttattcttcggcatatttgctgaagcctttttttcatctgaaaaaaccggcctcttcgggccggtttttcaatcattgtttcttcattctgatcacattccaggaaagcttcggaaggtgagccgtcagcctgccgtcacatactttggcgtctccgccgctgtgcggaacgacgttgttgcggtctttttcattcgtcgctttatgatcttcgtgttccagaacgatgtgctcagagacactgtacccttcaaagcttctcatatcggcttccatttcaaggccggcgtctgttgcgcggttgacggcaaaaacggttaattcctcggcttcttcattgaaaacagacacggactccaagtacggcacatccgtaaagtctttcgcatcatactttggagacgataccgccgtctgcagtaccgttcctctgccgtagacggaagcgtgcataaacggatagaaaatggtctgacgccatgcttctccccctttgtctgtcataatcggcgcgatgacattgacaagctgagccagacaggcgattttcacgcggtcggcatgcttgagcatcgtaatcagcatacagccgacgagaagcgcatcctcaaagttgtagatgtcttcaagaaggtgcggcgctttcgcccagcgttcagcttctttgtctttttcattcgagtgataccagacattccactcatcatatgaaaggtgaatcgttttcttgcttttctttttcgctttcatatagtcgcagactgagatgaccgttttgataaagtgatccatgtctagcgatctcgccaaatagtttggaagatcattgtcgcggttgccgtaatacgagtgaagcgagatgtactcgacgtgttcgtacgtatggtcaagcacggtcgtttcccagtcgatgaatgtcggcattccgcttcccgaacttccgcaggcgacaagctcgatcgacgggtccgtccatttcatcaccttcgcggcttcagcagcaagtcttccgtattcggccgctgttttatggccgatttgccatggaccgtccatttcattgccgaggcaccatgttttaattttatgcggttccttatatccgtgggattttctcaagtcgctgtagtacgatcctgacggatggttgcaatattctactaggttgcgtgcggcatcaattcctctcgttccgaggttgacggccatattcacctctgccccgacaagctttgcccaatccataaattcgttcgtaccgattaagttcggctcggttgtcgcccacgccaaatcaagtcttgtcggccgctgttcgacaggtccgactccatcctcccagttatatccagatacaaagtttccgccgggatacctgataaacggcacctttagttctctgactagtttaatgacatctttccgaaagcctgattcgtcagcttcaggatgatcaggctcataaatgccttcataaacggctctgccgagatgctcgataaaggagccgtaaattcgcttatcaatctctgccaccttatattccttgtcaatcgtcatcttcgctttgtgtacagtcatgttaaatcattcctttcaagatgatatatagtggatcagcctttgattccgcccgccgtcaaacctgatataaagtacttctggaagaacaggaagatgagaatcacgggcagaatcgccagcacagaacccgaaatcaacatgtcataattgttcccgtacggactgagcaaagcggacagtccgattgggagcgtaaacatttctttcgatcgcaaaacgatcagcggccataagaagttgttccagctgtttaaggattgaagaatgatcatcgctccaaatgccggcttcatcaagggcgccatgatcctgaagtaaatgccgaactctgtgcagccgtccattctcgcggaatcaagcaaatctctcggcaggccgagcgcatactgtctgaagaaaaacacggctacaggcgagacgataaacggcaggatcacaccggcgtatgtgtcgacaatatgaagagaaaccgtcattttaaataaaggcagcatgagaatttcgatcggcaccatcatgatcaggagcacggctacgaacaagagattttttcctttaaagtcgtagacggcaagcccgtatccgaccattgaagaaaacaagagcgtcagcacggtggatatcaccacgagaatcaagctgttcgaaaaccattgaaaataaatgctgcctccgttaaacaagtaagtgtaattgtcaaggctcaggatttcagggctcagctttaaattcaggccgaagcgcagcaattccgaagatggcttgagcgagccgagtacaaggcagaagagcggaaacacaaacaaaaagcttaatatcgcaaacagcagaaacagagctgctttcgcaatgttgaggcctccggcaggacgcattaatagccctcctttttaaaagatccagacagctttaatgaaatgaggctgcagatgaaaatgatgatcaagagcacgatgccgagcgccgatccgtagcccatgttgttgtaggcaagcccctgctgataaatgtatccgaccatcgtcaggccgatgttgcccggagagttgttctgccacagcacgtagctttcttcaaacatccggaagccgccgatgatgctgatcgtcagcacgtagacgctgacgggctttaaaaacggaagcgtaatatggtaaaacttcttgaacgtgcctgccccgtcgatttcggcagcttcatacaattctttcggaacgttctgcaagcccgccaaaaagtacaggacattgatccccatccatctccaagatgcgagcatcaccattaaaaacatgccggtatgttcattgttcagccagttgtacggcgaacctccgagcttagccaatatcgaattcgccagggatgtatccatttctccaaaaatcagcctgaaaataatccccgccacaatggttgaagtcagagccgggatgaataaagccgatttgaacacgtttttaacctttacgagtttagaatctaaaaagactgccagaataagaggaacaggtattaaaatcagcaatgtccaaaaggtgtattttacggtgttgaatagtgcggtataaaatgtaggattgtttaatgctttatagttctccgtcccgatgaagcggacttccccggggagaatgctttgaaaactcatgatgacgacgctgataagcggataaagaaaaaatatgcaaaaggagagtacaaaaggtgctgtaaaaatgtagggtgcggcttttgctgaatataataaacgtctgatctttctttttctgctcaccggcggaaacgaatgcactgtatctgttttaacagtcttcaagttatcgcctcgctttacagtaatgaaagactattgccctttcacttcagctgctgctttgtccaatgcttctttcggtgttttgctcttcgttttgagcgcttcgtacagtatgtttctgttgacgagatcggaagtcttcgcataatcctcagtaaggtaaagcggattgatctcatcctttatgtcaagaagcacggaaaagatgtgttgtccgttttgaaagtattctgtatattgatttggttttttcaattcgtccgagtcccacacatcccatctgagcggatcgaacccgagcacggtccacagcttgatgttgccttcttttgacgctttggcaaatttcaagaaatccttggccagatcgacctgtttcgcctgttttggaatcacggtggccgttccgcccattcccgctgagcggtctcccccttcttcccatgccggcagcggtctgatcgcgattttccctttcaagtcaggcatataatccaaaaaacggcccatataccagatcggcattaagacagacgccgcgccgccttggttcataaatccgtaatactcttcactgtgatgattgcctccgggcgttgtgacggcaattttgtctttctcaattaaagtctttaaaaattcgagcgttttcacgtttgtctcattgtttaatgtcaaccgcccctgctcatcaaagtaaccggatccctgctgggaaaccagcggcagaaatgaattcgggtcggtcgtttcaatcgtcgtcatcggctttccgagagctttgacgacctttttgcccgcttccctgtaatcttcccatgttttgatgtcgtccggatcaacgcctgctttattcatcatttccatgttgtaatacatcacggttgttccgacatgtgtgtcaagtccgtaaagcttgccgttcttgctgtagagcgtcagcctcgcttcaacaaacttgtcgcgttcgtcctccacaagcggcgttaaatcggtaagaggaatgtcagagcccttcaaaaagttcgaatagcgccccagctcaacatcggcaatatctggaacccctttcccggctaaaagcgagatagataaattgtcatgcatctgtccatacggatacaccactgtatttaatttgatttttcgctcgggatactttttgttccattctttcaccatctcagcataaaactgttcatgaaggccgttgaatgtccaaaatgtcagttcggtgccgtccgcttgatcggaggcaggactcgccttgcaccccgataaaagcaaacatacagcgaccgtgaccataaagatagatgaaaggaaccttttcacattttaacccctttcacgcctggtcctttgcctaaaagccccggcaaaaggccgtattgattgatgattttcagtcccgtataccggtctctgagctgatgggcgtatgcgagcgcttctctcaccagctcttcttcaacatcgagttctttgaatgatacaggcccgccgatacgcctcatccactctgccattttcttaccgtcagggagcttttcataaacggagcgaatcgcttgctcagcgtgttgatcacccaggcttgcaccgataagagatcggtaaatgtcagtcagcataatcgcgctgcagccgactttagcaccgtggagcacttgccgcttattgttctccagcgctttcatttcaaggtagtgggaaagatggtgctcgccgccggaagccggccttgaatggtcgagaaccagcatgactaggccagaaaggatcagcgattccatcaatttctcaatcccatcccgcatcttggcggcgatgtcatcttttcggtcaagacattgatcaagcgcttccctcgtgagccggctggcggccggacaatacggctcgccggcaagcaagcgggaaatctcccaatccgcaagcgacgtcaccttgccgagcatatcgccaaaacctgcggctaccatgttctgcggcgcttgacacaagagctccaaatcggcaaaaagcgcgatcggcgctgtcgtttgaaccgtctgtttctttccttttaaaatcagcggtgcgccggctgaagtaaaaccgtcaaccgacggagccgtaggaactgaaataaacggaatgccgcgctgataggcgcaaaacctgacgatgtcgtgaatcgtgcccgctccggccgcaattagtacatccgcatcaatcggtacaccgatcaatgcactcaccaatgtttgctcatccgccgtcacatcgcccgcttcattagcttccagcagcaccggaaccgtttcagccgtttcctcaagaagagaggcaatccgcttgccggctaaccgtccggtcgtttcatcataaatgacagcggcttttttataggaagccgatttcacgaaagcgggcagctcttgctcaacagcattgtcgccgatcgcgattttttcgactgtaagcgggtggtggacggttccgcattcgcatgcgcccaaagtttttttcacataagagatcaagtcattcattggcagcttccctcctctattggccgtaataggcgtctgccccgtgctttcgaaaataatgcttatcctgcaaagcgctcttaatccgcttaagagacggattcagcatcagggagcggtacgccatcttggcgacttcttccaggacgacggcattgtgtacggcagttaaggcgtcttttccccagcaaaacggcccgtgattgttcacgagaacggcgggcacctccagggggtcaagatgccggaacgtctctacaatcacttttcctgtattcagctcgtattgactcctgatttcatcgggatccatttcccgtgtacacggaatgtcgccgtggtagtagtcggcatgagtcgttccgagcgacggaatgtccttccctgactgagcccagcttgtcgcccacggggaatgcgtatggacgatcccgccgatcgattgaaactgccggtaaagatagaggtgtgtcggcgtatcggaagatggcttcagatccccttccacaatctcgccgtccatattcagaaccactaaatcttcggctttcaaatcgctgtatttgacaccgctcggcttgatgacgaccagcttattctcccggtcaataccgctgacatttccccatgtaaaggtgacaagccggtattcttcaagctgcaaattcgcttttaatgcttgttctttcaaagattccagcacagttttctcctccctctaagccatcgctttaccggggtcagaactaagggactggatgtttttcaattttttaaggcgtttcatcacattgttttgctttccgaagtacgtgtaaagctccttatattccgcataaagctgatcgtataaggaaacgttttcaggaattggtttgtacgttttatccttgatcttgcccatatgtgcgactgcttcttcgatatggtcgtaaccgccgttcatgcttccggccgcgagcgctccgaatatcgctgaacctaaagccggcgcctgcggagatccggaaattttgatttccatgttggtgacatccgcgtaaacctgcatgataaacggatttttttcggcgattcctcctgcggcatacagctcctcgatcggcacgccgctttgtctgaacgtttcaataatgatcctcgtcccgcaggcagtcgcttcaaccaatgcacggtatatctcttcaggcttagtggcaagggtcataccgagcagcattcccgtcagatcggcatcaacgagtgttgaacggtttccgttccaccaatccaatgcaagcaaaccgctttcaccgatttggagactgccggccttttgagacagcagttcgtaaatggaaatcccttcggcttcggcttctttcaaatacgcttctggaacaaagtgttgaatcagccaatgaaaatggtcgccaacgcacgattggcccgcttcatagccgacatagcccggcagaatcccgtcttcaacgacgccgcacattcccggcaccatcctgacatcctcgccgagcagcatgtgacaggtagacgttcccatgatcatcagcatcttgcccggctctgtgatgccgaccgccggaaccgacacatgagcatcaacatttgcgacagcgaccgccgtacctgccagaagccctgtcttcccggccatttcttcagtcagtccgcccgctttttcgcctacagaataaatatcctccgttagtttttcccgaacgatatttttcagcttcggatgcaggcttgcgaagaaatcgtcggaaggatagccgctcttattgttccaaatcgctttataacccgctgtgcaattgttgcgctttctggttccgcacagcatatagacgatccagtcggccgcttccatgatctcggctgcggcatcataaatgtcaggcgcttcttccgcgatttgcatcacttttggaacgagccactcggaagaaattttcccgccgtatgtttgaagaaaaggttcatttctttcttccgcgatttgatttaagcgattcgcctgctcctgtgcagcatggtgcttccaaagcttcacatagctgtgcggttccgacgcatactcttccctcatacaaagaggagtcccgttctcgtcaacgggcaaaatcgtgcaagccgtgaaatcgattccgattccgatgatttctttcggatccgcttttgactgtttcaaaaggctcggaatcgtttcctccagcacttcaatgtaatcggccggatgctggagcgcccagtctctcggaagctttcgctttgagaccggaagctcccggtctatcaccccgtgcgtgtactctttgacagctgtcgcgatttcctcacctgtccggacatcgacgagaactgcacgccctgacaatgttccaaagtcaactccgattgtgtaagggataagtcctcacccccttaaaacttgcgaagccgatatgcagcttcactccatttgagttcattgcgaagatttaaaatcgttgtatcacgattgatcaacaccgcttcaatgcccgacatttcggcccaatcgagcatctgctcggctgtcagctggtacgaaaggcatgtatggtgagcaccgccagccaaaatccacgcttcagccgatgttctcagagacggctgaggcttccaaagtacgcgcgccaccggaagattcggcatatcatgcggaaccttcacagcttccactttattgatgacaagcctgaaacgtccgcccaaatcaataagggagacattgaccgcaggacctgcaattccgtcaaacacgagccgcgccggatcatcctttgcacccattgacagcggatggacttcaattctcggtttgtgttcggcaatcgaagggcacacttcaagcatgtgggagccgaggatcatttcattgcccggttcaaaatggtacgtgtaatcctccataaatgacgtttcttttccgccggccatcattttcatcatcctgacaagcgcagccgttttccaatctccttctcctccgaagccatagccttcagccatcagccgctgaacagccaaacccggaagctgcttcatgccgtggaggtcttcaaaggttgtcgtaaaggccgtatagcctccgctcgaaagaaagcgctttaatccaagctcaatccgcgcctgctccttgacggattcccttgccgcttcgccttccggccactcataaagctcctcatattcggagatgagctcgcttagactctgttctgatacagcattgatctccgtgacgagatcgccgattccatatccgtcgacagaccagccaagctgaatctgcgcttcaatcttatctccttctgttaccgccacattccgcatgttgtccccaaatcgggcgactttgatatggcggctttcaatatatgcgaccgctgcgctcatccatttgtcgatcgagcgctttacttctctgtcttcccaatatccggcgattacttttcgaggaatgcccaatctcgctccgataaaaccgtattcgcggtcgccgtgggcagactgattaatattcatgaaatccatgtcgattttatcccacggaatgtcccggttaaactgggtatgaaaatggagcagcggcttattcagctcggaaaggccgggaatccacattttggccggtgaaaacgtatgcatccaggtgatgatgcctgcgcactcttcgtcccggttcgcctcttcaaacagttttctgacgccgtccagcgaagtggccaccgctttgtactcgacttgaaaccttaaatctccgtcatttaatccgttgcagatcattttggaatgctcttctacctcttgtaccgcctcttcgccatataaatgctggctgcctgtcacaaaccaaaacacatgcgtctttgcctgaatcaaatagcttcctcctcctcgtctttatggtgtctgtgtagaatagcaaactattaaaacgcttacaaaaaaacataaatcataccttgatctcaaactgtatcgcgattatatgtacgtacaactaacatcaaaaacatatttgtacgaacaacttcattatatcattatgaaaaaaactgtcaatttaatttccggtatgttttttattttttttgacagatttcagaacaaaaaaaccgggcggaaaccgcccgtcatctgctgttaataagtcggccacccttgggaatcccagtacaagtcattgatgagcagctttgatacaccattgtccagcgcgtcgtaagcatgcctgacaaggatcgagttgttcagaacatcctgatgtcccggccctttccagcggtcattgccggagtccaggatcgtccctccgccgttcatcatatttttgccgcttttatcataatagggtcccgtaatgctcgttgaacggccataggctattttatatgtgctgtccacccctttgcagcagctgtcaaacgagacaaataagtaatagtagccgtctttgtaggtaatgttcggggcttcaaccgctcctccgttattcggccttgaggcgatcgaatacaggcttcccgtcggtttcatcgtgtttttatcaagccttgtcagcttaatgccgctccagaaggaaccgaatgagagccaggggtttccgtctttgtcaatgaccagatcagggtcaatggcattaaactgatcgccggatgtcgacctgatgaccagcccgtcatcccgccattggccggatgaaatccggtctgtcgatgcgagccctatcgctgatgtgtttgaaccgaaagacgaaaccgagtagtacagccaataccggccgttatagtagctgatatccggtgcccattgatgcggttcatgatttggtacgtacatcttccaccatgacaatggagttggaaaaatactcggggcagcactccagtttctcccgtctgttgacttaatgacacgcagccctgtgccgagccctgttccaaatgtataccatgtatttccctctttaatgatagaagggtcatggatgaaattgtccccttttgtgtcccaaaacgccgctttgcctgattcaggcatcgaaaaagacagcagcagtccgaatatcaaggccgccaaagacattttccgcaacacatttttcattcagctcacactcctgttcttgtaatgaaaaaaacaatgcctccctttctttgtcaatttttcgaacaatgtttatatatgtaagcgctgtctttaacattccaaaaaacaaaaaaagctgacagcttgtaagataagctgtcagcctgctctttcatcagtcaaacgtaatgttttgaaccgtctctttatccagtcgtttaatgacttcggtaattaattttaccgcatgttcatagtcatcccggtgaagcatggccgcgtgcgtatggatatacctcgtcgcgatcgtgatcgacagggcaggcactccgttcgcggtaaggtggattgatcctgaatctgttcctccgcctgagagggcgtcaaattgatacggaatgccggcttcatctgccacattcgttacaaagtcgcgaagccctttatgggacaccattgatgcatcataaagtatgatctgcgggccttttcccattttgcttgccgactctttttcggtaataccaggcgtatcacccgcaattcccacgtcgacaccgaaagcgatatcaggcttgatcgtatgcgcggctgttttcgcgcctctcagccctacttcctcttgtacggttccgacgccgtagacgacattcggatgatcggctcctttcaggtttttcagcacgtcgattgcgatcgcgcagccgatacggttgtcccatgctttggcaagcagcattttttcattattcatcaccgtaaattcaaagtaagggacgacctggtctcccggaagaacgccccattccatcgcttcctccctgctcgacgccccgatgtcgataaacatatctttaatatcgaccgatttttttctcgcctcctgagacaggacatgaggaggctttgaaccgatgataccggtgatgtcgcctttctttgtcacgaccgtcacacgctgcgccagcatgacctggctccaccagcctccgaccgtctgaaagcggagatagcccctgtcatcgatccgcgtaaccataaaaccgacctcatcaagatggccggcaatcataatcttcggtccgtcagcctgtccggtcttttttgcgattaagcttcccagtctgtctgtcgtaacctcgtcggcaaacggttctatgtacgatttcatgacttgtctgggttctttttcattcgccggaattccttttgcatcagttaattcctttagcatcatcaatgtttcatcaagctttgccatctctatacagcctccttaattaaccctcatttactattatacagaaacatcccttttcaatacgaccaatatcgtttacagcttttttggttaaaaaatgaaaccttgcgggaactggttcgtatatattgggatatactcaaaattactttcaagggaggttctgttttaacatgattgtcatcatattgagactggctttgctggcgcttttggtctacgtcgtgtacagggccgttcaatttttggggagcccggacagaaggctgaaatcagcacaggcaaaaaagcacttttatgttttggacgaacaaaagaatacacgcaaaaatctcaagctgacatttaaaggcgtgcttttcgaaggagaaaaacacattccttcaaaagaccatccgctgttcatccatacgatttttgtatggacggaagcgcctgaagaaaagctcagctcttttacggaagaagacttcgcggaacttgaagaaaatattaaagagcactatcccgattgcaaaatcgactgggattcgaacatccaaaagtggaaaaacaaaaaagcagaagagcaataaagcctcgtctgcttttttaattcatcatataaaagccggtcaaaacagcttgcacgccgagcaaaaaaggaatgccgagcctgaaggaaaggtgttttgtcttatgtctgaaccgcatcatcccgaaccagacgcctgcggagccaaaagcagccgcaacgagccagatgcggcgctcagacaccctccatttgcctctgaccgctttttgcttatcggctttcattaagaaaaaaccgtatccgtttatgaggatcatgtatatccatatgagagtcaattgttcatttccccttgtttttcggtttgggcgcctgctgcggccggcctccccgaatcgttttacatcctgctcgaagaacaaaagaaaaaggccggagcccggccttttttcaattatttattcaattgcgctttagcagcgtctgcaagctgattgaatgcgttcagatcgtttacagcaaggtcagcaagcattttgcggtttacttcgataccggaaagcttaagaccgtgcattaaacggctgtaagaaagaccgttcatgcgcgctgcagcattgatacgagtgatccaaagtttgcggaaatcgcgctttttctgacgacggtcgcggaaagcgtagtttcctgatttcataacctgctggttagctactttatataatgtatgttttgaaccaaaataaccttttgctaatttgagaacctttttacgacgtttgcgtgtaacagttccgccttttactcttggcattagatttccctcctaattataccttttccgaaattacttaatgttggcaagctgctgcttgatgcgtttgaaatcgccggcgcttacgactgcgcttttgcgaagcttgcgcttttgtttttgagatttatttgcgaacaagtgacttgtatatgcatgagaacgtttcagtttcccggaacctgtctttttaaaacgtttcgcagatccgcggtgagttttcatttttggcatggatgtttcctccttaattacttttcagttttaggcgcgagcaccaggaacatgctgcggccgtccattttcggcttcgtttcaacagtcgccacttccgcgcaggcttctgaaaaacggtccagcacgcgctgcccgatttctttatgcgtgatcgcacggcctttaaagcggatggacgctttcactttgtcccctttttgcaggaacttgatggcgttgcgaagctttgtattgaagtcgtgttcttcaataccagggctcagccgaacttcttttaagttaatgattttttgatttttgcgtgcttccttttccttcttctgctgctcgaatctgtactttccatagtccatgatccggcagacaggcggttttgcattcgctgcaaccaacacaaggtcaagatttgcgcgacccgcaatttccagtgcttcctggcgggatttgatcccaagctgatcgccattttgtccgatcaaacgaacttcacgcgcacggataccctcattaaccaattgatctttgctaataatgagccacctccatagaatctttgaattgatttcacaactcattttgaccgtttctttgcattccacaggcaaacaaaaagtgcgggcatcgaaacacccacactgcgaacattgcatagaaaaataagaaatgtacgtttaacctgccaactacaagaatgtgtcaatcaggtgagaagcgggtgcttctgcttgttgatatatattcaattcattatccatcttacataaacaaatcctgcaagtcaagatataaaatttatcacaacatttgctattatatcaggacacatttcaaatagcaatgctatttttttatttttctttcagccgctctatccgccgatcatttgaacacataacggaacgacaaacacggtcacgacgccgacgacgacaactgcaatactcgccattgccgcttcgacttcccccatctcaattccgacggcgacgccgagggcatgtcctgatgttccgagcgccaaccctttggcgatcggatgctgcactttgaagattttcaaaaaaagcgcgccgagcgcatagacgatcactgcgttaaagatgacggcgaaggccgtaatatcttgaatcccgccgatcccttttgataaaggaagagcaatcgccgttgtggcggcctggggcagcatgcttttcatgacggctccgtcaagatggagcgcgtttgcgatcagatagacgacggcaaccgagcagacggagcctgcaataatggcaccaaggatttgcagccaatactttttcaacttgtccgcctgtttatataaaggaatggcgaacgcaattgtggcgggctccaaaaagaacttaatgatgtctccgccgctcttgtagtcctcatatgaaaaaccgccgatttttaaaaacgcgatcccaagaatcatcgcgacaaacagaggcgtgaataagaaaaaaccatttgattttttaaataaaaaagtgccggtgccaaatgcggccagtgaaacgacgataccgaaataaggtgtcatagcgtaaagaacctcctattgattcaagatgctgtttttttggctggttcaactcgtgtgtcttgacggtcctttttgccgacagacagaatgaactgtgaaaacaatcctgtcgctgcaagcagaatgacggtggccaggaaaatcacgaggacgatcggcaatccgtatttctccatgacgccgagcgaattcatcactgatattcccgacggaacgaacaaaaagccgatcagcgaagtgagcgccgtgccgagcgattcaacttgttcaagcttcagcaccttcgtacacagcaatgcaaacaacagcaccaaaccgatgacagatggaggaatcgggatgggcagaaccgcggcgattccgtttgaaataaacatcataacagcaaaaataaatgcctgagttaaaaagccgtattcttttttacccttcatttcgttcacctctttggctgtgttgggttcattatataaaaagagcctccccaaaaaagcgttttcaaaataacttgccggatacggcccctcaattgcagaaatgggaagctgaaatgcaaatcactcttccggctttgcaaattcttcacaattatttaaattccagaatgtgctaatgaagctaagctgatcgtatagtggttaatgagaaattgatgaggaggccctgacccatggaccattcaagaggaggccgctttgttccgtctggcgaatttgcatctttggcaaggcgcggcttgatgcctgaagacgcttcaatcgccgcaggcgcgccccgatttgcagattatccattcaagcttggagtggcttcaggagacccgcatcccgacgggtttgtcatctggacgaggcttggccccgatccgcttgccgaagacggattagggggaatgcctgacaaagctgtccctgttcagtgggaagtagctgaagatgaacattttcacaaagtggtgaagcgcgggacgtcctctgcgctcgctgagcttgcccactccgttcatgttgaagtgcacggtttaaagccgggaagctattattggtacaggtttaaagcgggcagggaaatcagccggacaggccgtacaaaaaccgcgcctgccccgcacgccgacatcaaggggatgtcgttcgccctcgcctcgtgccaagcttggtaccacgggtattttacggcttaccggcatatggccgaagaccatccggacgttgtttttttcctcggagactatatttatgaatatgccattaatgctaaaaatcttttccgcgatgtgactttatccgctacccacaacgcaaaaaccgttaccctcagccaatacagactcagatattctctttttaagacagatccggaccttcaggccattcatgcgctggctccctgggttgtgacgatggatgaccatgaggttgaaaacaattatgccggcatccattcgcaatacaatgcttctccggacgattttctccggctgcgcgcagcggcgtatcaagctttctatgaaaatatcccgatccgcagcacatcgattccaaaggggcctgacatgctgatgtacaggcggttccgctatggaaacctggctgaattcaatgttttggacacccggcagtaccgcaataattttccggcaaatgaggctgaacggcttgagccatcccgctccatactcggatttgaccaggagcgctggctttttcacggcttgagccggtctgacacgatttggaactttttagtccagcaagtcgtgctggctcaaatcgaccgcgacacaggtcctggagttgagtacagcacagaccagtgggacggctttcccgcttgccgcgacaggcttttttccgcatacaaggcatacggcatccaaaaccccgttgtactgacaggggatatccacagacatgccgccgccgacttaaaagcggacttcgatgatgcggggtcagcgacaatcggaaccgagctgatcacaacttcgatatcttcggacgctgacggcagcgagaccgattctttggcgccgatctggctcggaaacccgcatgtcaaactgtacaatgcacagcgcggctatgttcgctgccgcttgacgccccggcagctcgaagccgactttcaggttcttccttatatcacacgtcccggcgctccagcctcaacttatgccaagttcgccgttgaagcaggacgccccgggctccagcgcatgttttagctaaaaaacggcggtgaaagacgaattaagcccttcaccgccgctgatcattttttcacaccatatgcagccgttttttcagctctttcgcgtatgtacggctgacagggatcgtggagccgtctttcatcaggaggttgtatgtcgaattgaaccagggtttgacctgtttaatatgatccatatttgcgagaaaacttctgtgcaccctgatcaatgccgtctgcgaaagcttttgttcgagtacaaccaatgtatcgtgaaccgtgtatgcctgatcaaaagtcttcactgtgacgtgtccgccttctaacccggcgtatacgatttcatcgggatcgagcacgacgatcgattcgtcaatgctgagagccagcctgtggtggcctgcaagctgccgctcctcctgtttgccggggcgcatccttttatatttgtggattgtctgtctgattcgctcctcatcaaacggctttgtcaaataatcaatcgcatccacttcaaatgctttcagcgcatattcatcataagcggtcgcaaaaacgacagccggaggcgccgacatttttttcagccgctgcgcaatgtcaaaaccgttctcccctgacagatcgatgtccaggaagaggatatcgggtttgcgatccgccattttgtcaaacgcttcttcgatatgttcagcttcgtcaatcgcatccacttcttcagtctgctctagtaaatatctcagctcgtcccgcgcaaacatttcatcatccacgattaataccttgagcatctctgttcccctctctttcggtttgaaaaggaatcttgaaggatatctctgttcctttatcaagttcgctggcaatctgcagagcagcctggtgcccgaacaaaccggtgagccgctggttcacattgtaaagcgccgtcccatttccttcctttgaaggggcgggcgcctgccccagctgtccaagcatctccggattaattcccctgccgttgtctgacaccttcatcaaaacgccgtcccgctctctcacagcgcatacttttaccgtgcataccttttgttttctcggaaatgcatggcgaagcgcattttcaacgagcagctgcaagataaaaggagggatttccatattttcaaggccgtcctcgatatgaaaatcaatatgatacttgcccggaaatcgggcctgctccaatgataaataggcttccagatggttcagctcttttgaaagcggaatcatcagctgcctggctccctgcagattggaacgaaaataaacgctcagctgcaagagaagttttcgcgttttttccggatctgtcctgcacagagcagaaatcgtatggatggcattaaataaaaagtgcggattgacctgcgcctgaagcgccttgatttcggcatctttcaaaagcttgctttgcagctcagcctcaccgagttctagctgagtggaaaaaagcatggcaagcccttcggccagctcttccgtcacacggttaagaccggacgggtgcttgaagtacagcttcagcgtgccgattgtttcgcggttggagaagagcggcagtacgatcgccgcctgcagcggacaggaacggtgcgcacactcgatttcatcgcgcgacttcactttcatgacctttccggtttgaatgacttttttcgataaaccggtgatcagatttttcgaaggaatatgatgatctgctccatctccgacatgagcgagaatgttctctctatccgtaatcgatacggcatccgtccctgtcatgcggtgtataatgagagcggcgcttttgcaggaatcctcattcagtccccggcggaaaaaaggaagcgtctgatccgctatcgaaaataccttatgggtctgaacggcccgcgcctgttcctctttgcggataatagactgaatgatcgatagaaaaataaagctgcccgtcccgttgacaatcgtcattggaatgccgatcatctgaacaagcgcaagtgcctcagcctgcggttttgcaagcacgagaatcataagcatctgcaggccctccatacaaatgcccgcaagagcggctacccgcggtgtcaccatctggtgccgattcctgaaaaagctgccgatataacccgcaatgacacctgccagcagtgaagaaaccgcgcagctcaaagccgtcgtccctcccagtgaaaaacggtgaatgcctgagagcagtccgacacccgctccgacaaacggccctccgatcaagccgccgatttcgacgccgagaattctcgtattggcaatcgagcttgacgggtcgattgcgaaaatccagtcattgttcaaaatctcgcgctcccggatttcaatgcctgtatagttgctgatgatgctgaacaaggaaaaaataaagatgagaactcccttgcccttatacccttccggatgctgtaggtgctgacggaacaccttcatatgggccaacataaagcccagaatgacgatgatccccactctctccagcatcataatcatgagttggaccatgtacttccccttgctttctttctgaatcggaatctgctcttattctatcatacctctctttattcactctttgagacggcatggctttaaaaccttttaacggccaaaaccgcttcatgagcaaaataaaaaaggcagcaattgtctgccgccgtttacttatttgctgcttcccactttgaaattaacaatcagccacacaacttgaatgatgaatggaaatataaatgcaattaacaaaacgataaatgctattaatttaagttcaggtgtttgagcaacaccagcgccatcaacatctctcagccaaacaacagctgctccgattacaaaaacggccgtccacaatatgttgcaaatccaccaaaatacccagcgttttttcacaataccattccttccatctcctcaactataaaacgattcttcctcccgcgcatgggccagcatcaccatcatcaaatagatcttagaaacgttttccaaacaatagatttcgtttcattttatcatattcaagaagctttcatactttgatactgcattacatcacattcttaaatcatttctttcacatccctttgatctattgtaaaataaatgagagaattctataaattaatggcagaggagaagatgatgaaagccgtattttttgatttagacgatacattgctctgggatgaaaaaagcgtcagcacagcattttccaaaacgtgccttaaagctgaagaaaaatacggaatccatgcggaagaatttgaagcagccgtgcgcgaagcagcgcgaaagctttacatgtcttatgaaacatatccatacaccgtcatgatcggcatcaacccatttgaaggactgtggtcaaacttcagcgagccgatcagcgaagggtttcaaaaactgaacaaaattgttcccgaatacagaagaaacgcatggacaaacggattgaaggcgtttggcatcgacgatcccgccttcggggaagaactcggcgaatattttgcggcagtgcgccgaaagagcccttttgtttatgaagaaacatttgccgttttagatgagctgaaaggaaaagtagagcttcttttgctgacaaacggcgatccgagcctgcagaaagaaaagttggcaggcgtaccggaacttgctccttattttaatgaaatcgtgatttccggtgaatttggaaaaggaaagcctgatccaagcatatttgaacactgcctcaccctcctcggcatgacaaaagatgatgccgtgatggtcggagacaacttgaacaccgacattctcggggcttccagagcaggcatccaaaccgtctgggtcaaccgcaaaggcaaaaagaatgaaactgatgttgcacctgatcacgaaatcagccatttaagcgaactgttcgatatcctccgcggacaagcagcggacaagctaagcaaaaaagcatgactcccgggcgggaatcatgcttttttcttgtttatttctttgcttcagcaacggcttttttgataaagtctgcaattgcaaccgtttctgatttttgctctccgtatttgcggacgttgacggcttcgttttcaacttcctggtcgccgacgacaagcatgtaagggattttttgcatctgcgcttcacggattttatagccgattttctcgtcgcgggtatcgacttcaacgcgaagcccttcacgctgcaggcgctcttgaacttttttggcgtagtcaagatgcacagacggcgatacagggatgacctggaactgaacaggggcaagccatgtcggcaatgcgcctttatgctcctcaattaagaaagcgacaaagcgttccattgtcgatacgacacctctgtgaatgacgaccggacgatgaggttttccgtcttccccgacatatgtcagatcgaatttttcaggaagaaggaagtccagctgaacagttgacagagtttcctctttgccgattgctgttttgacctgaacgtcaagcttcggtccgtagaaggccgcttccccttcagcttcgtaataatcatggccgatctcgtccatcgcctccttcagcatcgattgcgctttgttccacatttcatcgtcatcgtagtatttctctgtatcttcagggtcgcggtaagacaagcggaatgaatactcttccagtccgaagtcttcgtatacatcctgaatcaggcggacagttcgaatgaactcgtctttgatttgatctggacggacgaaaatgtgggcgtcattcagcgtcattccgcggacgcgctgcagccctgaaagagcccctgacatttcatagcggtgcatcgttccgagctcggcgatccggatcggaagctcacggtagctgtgaatgtcgtttttataaatcatcatatggtgcggacagttcatcggacgaagcacaagtgtttcattgtccatctccatcggcgggaacatgccgtcttgataatgatcccagtggcctgatgtttcatacaggtctttgctgccgaggacaggggtgtacacgtgctcatagccgagcgcgagctctttgtcaacgatatagcgctcgatgacgcgtctgatggtcgcaccctttggcagccaaagcggcagaccctggccgactttttgcgaattggcgaacagcttcagttcttttccgagttttctgtggtcgcgttctttcgcttcctcaaggaggcgaagatgctcttcaagctcggcttttttgaagaaagccgtcccatagatgcgctggagcatcttgttgttgctgtctccgcgccagtatgcccccgcaaggctcagcagcttgaactccttgattttgcccgtcgaaggaacgtgaacaccgcggcacagatcgaagaattcgccctgctcatagatcgataccgtctcgccttccggaatcgcatcaagcagttccaatttcagatcatcgccgatttcggcaaacagggctctggcttcctctcggctgacttcttttcttacgatcggcagattttccccgacgatttttttcatttccttctcaatcttcggaaggtcttccggagtcagcgcttcttccaaatccacgtcgtagtagaagccgttttcgataaccgggccgaccccgagcttcacgtttttatacaggcgcttgatcgcctgggccattaagtgtgcagtactgtggcgcatgatttcaagcgcttcttcgctgccttctgtaatgatttcgatggcgccgtcctcaaggatcggtgcgcgcagatcgatttctttgccgtttaatttccccgctatcgcttttttctttaagccgggactgattgatgccgcgatatcttctgttgtcgtcacttttgcaaactccttaaccgctccgtcaggaaatttgatttttaccatatctgacatcctagtcactccttttttttacaaaataaaaaatccccgtccccctaagaaagggacgaggattaataaacggaattcgtggttccaccctttttcccgaaaacgcaaaaaacccggcgcgctctcggctttcggttctgtaacgggaagtcccgtcagtcattactagacaaattgccgttcacaactgatgttcaaaggcggtaaaaaaatgatccttggcataagagactttcagccatggtctccctctctgtcaaaccggtgttcatcttttcatgtccttatcaatacatgatatctttaagtttataccgtattataaattgtttttcacgcaaaatcaagaatgctcttccaaaatgttttcccgcggatgaaaggcgccaagcggaagaatccgcaccctctcctgaaaaatattttgaatggtctgaaccatggcgtgttcccggtcttctgtatagaggtctattttttccggcgcaatcgatacgagcggagccaggagatgggaatcaatatacattgggtgttctcttacgaaccgcctgtctatgtattttttttgttcccgttcagaaatatactttaattcccacaatacaaagtaaccgtcgtgcacaatgtggacatggtcaagcatcggctctttcgacatgacgtagtctctcagcgattgaatgaatgtctgatattcctgctccattttatactcgtcgatcgccgcctccacataagatctgaggcgttcataatacttcgcaaggcgaaacgtcataaatgaccgaatcgaaaagacgttttcctcaagacagatcgcttggagctcctgaatgatgaaatgttcgcgaggggtgtcgtccttgttgagaggaagcccttcaagttcgccctccataatgctgtgggccaattgaagaatctgctgctgttcatcccggtccaaaaagtaataatcgccttcaatgaccgaaagcatgtattcatcttctttgcattctgtaaaaaatctcgtcagaaccggctcaatataggcctgaatactgacagaggaatgggtcttttcaattccgatcttccctggcgcttcgtgaatcctgatatgccgattcgcatccgcattgcgaaggagatgcaaaaacgcggctgtatcataatcatcttcaaatgtaatttcaagcatgtttgtcccccctaacaacatctgttacatgtatatgggggtgacaaataaaatagacgtaaaaaaggatgagcccttaatcgaggagcgcctgcactttttttctgaacaaaagcggcactgtaatgaatatcaggtaaattgcggctgtaaccgcaatcgctaggatgtcgccggtcaagaggcttgacccgagcacgtttaaaataatggtgcccggtatgatacccgcggccgtcgccagggcaaacgacagaggcttcactttggaaacgcctgccgcatagctgaccgcgtcaaaatgaatcggcgccagcctcaagagcaaaatgcagaaaaagccgtttttccgcaaaagcgtccgcaggctgtcgagcttcagcggcatgtgctgaaagtatccgccgagcctgtatgcaagagcgaatgataaaaatgcaccgcctgccgcaccgataaaagaatacaaagagccaaacagcggaccgaatgcgaggccgccgctgacggcgaaaacggaagcaggaagcagcaaaaacggccggatcatcaatagtccgatatagatcaacggggcgaaaatcccaaaggataagacgccttctcttatatgagcagggctcagattcaggtatttcgcattcagccatagtccggccgccgcgattacggcgattaccgtccatttggccaaggttctttttcgcatcttcttcatctccgtgattgaagctcggtgtcaaatgattactgacgccggtttttcccgtccagccggacaggcgtcgctaaatacagcaccctttccatcagccttgccgcttttacttcttctttttctcccctttgcgaataggtgaaatggtgtttcagttcatcaggatcaaagtttgaagagaaaaacgtcggcagctgctgggacattctgtgctgaaggatggcgccgagcacctcatccctcacccagcttgacatggactccgcaccgatgtcatcgagcatcagaatcggcgtagacttgaccatatcaagcttttcctcaagcgactgatcatgtatcgcatttttcagctccctgacaaattcagggacatagacgagaatggacggatgatcctttgcggcaagctcatttgcaatggcggccagcataaaggtctttccgaccccgaacttcccgtagacgtaaatgccttttccctttcccgtttcgttatagtcatgcaagaatcccgtcacaagctgaaggaccttcaatctgctcgggtcatctccgtcaatatcggcaaacgtagcattcagaagatcctgttgaatatagatgcttttaatcagcgacctctgtctttccctctcgtccgctttctttttttccggacacctatcgtattgaacatcgattgtttttccgttcagcacaagctttggatgataaccctgtatcaggtttttgcattctttcagacccgggcagtcttggcatgctttgctttgctgtgtatattcataaagcttgttaaggctcctgtcgatcattccttgatccacttctgactggcggctgtttaaaaacgcctgaacatccttgtcagagagcactttttctttcatatcttcaaggcgttttttaaaatcgggtctcgtcgtcacgccttgcaaagcgcgtttaatcggctccatcatcttgtcacctcacattaaagagcggaatggtttttcagtttttttacttcttcgagcagcttctgtttctgctggtcaaagccttctctggttgcaggaccagcctgctctgtttccagcggtttgctgtcagcatcgtcactttcccgaagccaatcaggcagcttttcttctctgatgactttcttgttccgggaagtctttttcttcccttccgcccattcaagatattggcggttttcttctttcgcaagcttcatggcctctctaaccgtacgaactttttttctggcccagtgggaagcgattttttgcgtgtaatttttcgaaagcttcatatcggttttcagcatgacataataaatcagaacattgatgacgccgggctctaatttttggtcaagcataatttcttctataattttcagatcggctttggatggttccgctccgccgccaatatcctgcagcagctttcttggcgatacttgctcaagcaaagcgatcaaattgtcttccttggcgtttgtggacgactgttgattcggctgttcgcggagattcatcggctgcactttgtcgacgagttccggaagcgggccgccgcgctcgatctgataccagtcgctcgccgcttttctgagcgcctctgtcgtgatcatatcgtgttcgtcaacggctgacatgacgacgttttgcatctgaagcggttcgataccgtagagaaaggccagctttttaatcgtttcctttacttggtctgtcagcgcttttctcgggataagcgtgtcagataaaccggcgagaaacagttgaaagtcaaaggcgccgtctgtgactgctgccggttggctattcccttctttcatccattcatgatcttcgcgaagctccatcgcttcgatcatatcgtcggacatcttccattcgctcggctggacagatgcaaaaacttcattgaaagaacgggtgatgtcccgtgcttcttcaggaacagacgggtgggaaaaatattctttcagctgctgaaacctcgcctttccgacgcggttgtacaagaagacattcagcatgccgtcctgaaagaactcgtccggtctgagcggcggaatcaattcatatataaacaaacgttcgtgttccgtttcttttatataagttttcaacagtccgatcccctcaagcttttccttttctgagtgaatcgtcttcaggctggtctgcatcgccgccatcagctgtctgtgagtcgagctttttccccagactctgttttgctccagctctccccacagcgtgagaaacaagctgaacgaaaaagagccgattaaaggctgatacaatagcgtgacaatttgccggtccaagtcctgcagcaatccgctgcttttgacaacatacggatcgacaggaagcaaatctttccaataattactcatatcttttgtcaaccttccactttgtttcttgtcctcattttacacctttttcaggctttcatgtcacacgactgtgtttttgtcatgagaaaagagctggatcaatttacagctctttaccgttctttctttattaaatctttcagctcgtcgataaatacgttaatatctttaaattggcggtatactgaagcaaaccgtacatatgcgacttcgtcgattttcgcaagcctgtccatcaccatttctccgatcatgtcgcttttcacttcagaaacgccttgatttctaagctctttttcaatttcaaagcaaatatcctcaagctgcttcaaggcgacagggcgcttttcgcacgctttgatcaaaccgcggagcattttctcgcggctgaattcttcccggattccttctttttttacgacgatgagcggaatttcttccactttttcaaatgtagtaaatcgatagttgcacgattcgcattcgcgtcttctgcgaatcgatctgccttcgtcaaccggacgggagtccaaaaccctcgtcccattatgctgacatgctggacatttcattttttcagctcctattcaattgtttgaatgtacagattcctgcagctttccgtccagttcgctgtatagcgtcgagacaagcccgcggctgtagccaaaatcggtcggcaaaaacgtttcagttgacacattaaagtccaccgctgtatcaaaaggccgaatcgaaacgactgtcgccaccacaaaagcttttctcgtttttttaacttcggcgctgatttctcctctttcctccgacactgacgtcaccttgcagccgtcaaggccttccagcacttcctttacagcattgagcgcttcttttgacgccgctttataatagcggctcttcagctcttccgaaggatggcggtcagacgtttcggcgtgtgtagaaaaaaaccgttgaatgttttgaaaaagactcatatcccctgtcccctttgtctttcttctctatattttattaaaaaaatggttgatttccaagggaaaacaaaacagcaagagaatgccggggaatatggtttggggattttcgggagaggaaagaaaaaggagcggattttaaaagcggtgtccgctttttcatccagctcctctatcggcattaaagtgcctgtgctttggctttggcctgtttcacctgaacaggtcccatgcctctcggtatttcaatgttctctcttgtttccgctcttaactcttctgcgatataatcggcagctacgttcggatctaaatctccgcaagtataaacatcaatgctggcatatccgtgttcaggaaaactgtgaatggtcaagtgagattctgaaataatcacgactccgcttacaccttgaggcgcaaacttatgaaaggctacctcacgtacctcagcacctgacttcagtgccgcatttacaaacgttttttcaataaaatccatgtcattcagcttatcaaaatcgcatccccacagttcggagataacgtgacgccccattgtttccatagcatggaccccccttaacaagaattaaaaaagtgaatttccaagcaactgaaccggtcaattaccacgggggaaagttagtccggagaggtcctaaccctttaagtaatgccgaagcgctcacgaactagaagttcacgaaaaatagtatactttgtttgaatattttttgcaaggcggttttatcatttgatggttaaggggtatttatttttttatccgtccatgctcttattttatacagctgaggggtgtttcattcttgaagccgcgtatctgatcaaatcgacaaccctgcacgaatatccccattcattgtcataccatgcgagcactttcacctttctgttttcaagcaccattgtcgaaagactgtcgatcaccgccgagtatggattcgtattaaaatcggatgaaacgagcggttcatcgcatacatcgatgatcccggacatggagcctgccgccgccatgcggaacgcctcattaatatcctccgacgtcacatcgcttttcaaatcagccacaaggtcaacgagcgacacatttgagacgggaacgcgcagggccaggccgtgcattctaccctttaaatggggcatgacaagtgacagcgctttcgcggcgcctgtcgttgtcggaatgatcgaagatccgcaggcgcgcgccctcctcaagtctttgtgcggattatcaatatttttttgatcatttgtaaaagcgtgtacggttgtcaccaggccgttttcaatgccgaatgcatcatcaagcacttttgcgactggagcgagacaattcgtcgtacaggaagcgtttgaaataatcgtatgacgctccgcatcaaaatcgcgttcgttgacacccattacaattgtgatgtcttcatttttgcccggcgccgtcaaaataacttttttcgcgccggcttcaatatgtgcttccgctttttcctttgagttgaatttccccgtcgcttccacgacgatgtcgatcccgtattgtccccatggaagaagcttagggtccctctgattggtcagcatgacctttttaccgttaacgaacaggcagtcgtctccagcctttacatcaagttcataacggccgtgatttgtgtcatactttattaaatgagcgagcgtttccggaggatagctcgcattgatcaccgcaatgtcaatctgttcatcaagcatcgcttttctaaacaccattctgccgattcggccgaatccgtttatcgcaactttcactttcatcaaatatgcaccccttattttatgtcattccacatcatgatttattcaaaataagtataacacattatttttaattagccataccatttgttgctttcacagcaaatttacgcacttttgtgaaatcgtgaacaaaagactaaaaaaaatcggccctaaagcatatatttcaaatacacctttggtgctacaatttgcaacagcgctaaattttcaccgacagaaggcagtgtcttcaaggaaggacaaccatgaaactgatcaaaaacgcatcttttatcatttcttttttggctgcggccggcatttattttttattaggtacagtcgctgcttctgcggcaaacgaagattatccggaacagatgatcaggctggaaagctcatcaggcttaaatattacgcccgccgggaatcaagacaacgcaccgctaacagcaaaacagacgagcggagaaaaagaagaaagatggaggcttgatacgtctgacggcaaacaattcaaaatcagaaatatggatagcggcaaaattatcatccctgcccattacgcactgtcagacaataatccggctgtggtctactatgacaattcacggaaggaagagttgtggaatatcatcggggccgacaaagacggaaacggagattttatcacgtataaaatcgtcagtgcacaaaacagcagccttgcactgacactggacggcagcggagtgaagcttgccaaatatacgggcagctccgtccaaaagtggaagcttccaagcgacgggctcgaaggtttcgcaggctatgcaagggaaacgaacggcaagcagaaaacaggcacaaccggcggcctgcttggaaaagtcgtctatgtcaataatctgggcgaactgaaggccaatattgaagattcaacgccgcgcacgattgtcgtctccagcaatatcggcgcttcagccaaaacggtattaacggtgggcgccaataaaacaatcatcggctcgtatgaaaaacataagctgaataacatttactttaaaacaaaagcggactctggcaacgttattttcaaaaatctggtcattgcacatgatgcatccataaatgaaaacaatgacatccctgtttacattaccgattcgagaaactactggattgaccacgtcacattccaaggccacagctatacggcaaacggccacgatctcgacaagctcttatacgtcggcgctaaagccgattacgtcacactgtcgcacagcacattcacagaccacaggtacggcctgattctcggctggcctcaagatgacaagcaataccacagtatatataatggctatccgcggatgacaatcagccacaatcgctttgagaatctctatgtcagggcgcccgggttgatgcgttacggctattatcacgtgaaaagcaattatatcaacaattaccaccttggcttcacgattacgacattggcgaaaatatattctgaagccaattacttcggcacgggcaatgagaaaggcatactggatgattacggagacggcgcgtttaaagatgtcgggtcatatccggcgataaaggggcagaaatcgcctgagacaagctggacaccttcatccaactacagctatcggacgatgaaggccggcaatgccaaagcttttgccaaacggtacgcaggtgcgcagcgcaccgctctgtactatgcgaattacagccagtttaaaaaagactaatcaaaaaagtgagcgcgacattgcgctcacttttcaatatttgaccatgtatcaagcagctgatgaagctgcgcttctgtatctttcagactgccgctgttatcgatcaccgcgtctgcccttttctttttttcgtcaagagattgctgggcgtgaattctgttcagcgcctcgtctttattaagccggtttcttttcatcagccgctcaagctgaagctccatcggaacccagacaacgatcactttatctgtcaaatgttcgagcccgctttcatataaaagcggaatatcgagaacaacaaaccgttcaccggcccggatggcttcgtcgcgctgcttgatcatcatttttctcacttcgggatggacgattgcatttaactgcagccttttttcttcattagcaaaaacaatttctccaagttttctccggtcgatatcgcctgtttcaagcagcacgccttcaccaaatgtctcagcgattttctgataagcgggcatcccctgttcaacggcctctttcgcgatcacgtccgcatcgacgaccgtgatgccgcactgctggaacatttgcgcgacagtgcttttgccgctggcaatccccccggttaacccgatgaccaatgtcaaaggcctgcacctccttcttacagtttccagatgccgatcataatcagcaatataccgggaagaaaggtcagtttatccatccagttccatttcgataaaaatcggcctgcctgtattccgcaaaatacgaacaatgagctcatgatgcctaccgtaatgctcatcggtacaggggaaaagcccagcgcggccgcgccgatccctgcgccgaacgcgtcaatagagagggcgaaaccgagaaggaaagcttctataccggtaatgattcctgatttatcaatgtcggcgcttgtcggttttcttaatatgtgtatcacgattccgagcgatttcaattcaaggttaatgagcgttttttcagagaagacgagatcctgttctttctccggcctgaaaaactgatacagcacccatgcgccgatccccattaagatgacggctccgagcctttctgttacgacaacgggcaggaatttcgccaaaagggttccgatcatcatggcaatatacatcacggcaccagagcaaaaagcaataatcaaaatcgctttaaatgggattttcatctttcgcaatccgtaagtaaatccgactgaaaaactgtccaagctgacggcaaatgccagcagcaagaaagatgcaaacatcatatcaggctcttcctttctgttgatgcgagcagtgtaagtcatgcagcctaaaggcagctttctaggcttcttatatatatgaaagaagaaaaccatccgtgtgttgttcacccgaaaaagaaacatcacaccttaaagcttgcttttaacagctatatggagcgtatgcaccgacagcttgaaccatgatacggcttgcttttgtccttctatgcgattgtcattttttctggcactttatgcaaaaatgcgtgccccttccgccaacgactgttttttcaattggagatccgcattttttacaaggttcatctttcctgccgtaaacgaaaagtttgagctggaacatgccgatctcaccttgtgaattgatgtaagatctgactgtgcttccccctgcttcaacagcttcctttaacgtttgaatgatctctttatggagaagaaccgtctgtttttttgtgagcttgttcgctgttgcctcgggatggataccggctctgaacaaagcctcgtcgacataaatattgcccagtccgacgactgtccgctgatcgagcagcgcggttttcaccgagcggtttgttttcttcaggcgctctcttaagtaatcggctgtaaattcgctgctgaagggctcggggccgagctgcctgagaggcagctctgtcagttcctctcccggcttaaacaaatgcatggtgccgaactttctgacatcccggtagcgcagctcgcttccgtccgtgaacctgaaaatgacgtgcacatgtttatcaaggggttcatcgttttgatgaagcccgtactttccttccattctcaaatgggaaaccatgacacagtcatcaagatgaaacaacaggaattttccccttcttccgatcgactgaatcgtctggccggccaggagccttgcgaattcctcaggctcctccggacgttttatgatttttgtccatctgacatcaaccgcatcgatcgttttccctcttacaagcccggcaagagtgcgccggaccgtttcgacttctggtaattccggcacatcatcacttccttttctctattttgcatcgtaccatgaaggccctgaagcgcagtccactttcagtggaacatcgagctccaatgcatgttccatgacttccggaaccagtttttcaagcactttgatttcatcttcaggcgcttcaaaaatcaattcgtcatgaacctgcagcagcagtttggcctggagatttttttctttcagcttgtccgccatgtcgatcatcgcttttttaataatatctgcggcgcttccctggatcggtgtgttcatcgccgtccgttcggcaaagctgcgcagattgaaattccggctcgtcaattccggtatataccgcctccggcttaaaagagtcgttacatagcctcgctgcttcgcttcctgaacggtctcttccatgtattctttgactccctggaagctgtggaaatagcgttcaataaacgctgccgcttcctttcttgtaattcccaggttttgcgacaagccgtagtcgctgattccgtagacgattccgaaattgactgctttcgcctgccttctcatcgcaggggtgacttcttcttctgatacatgaaaaacgtccatcgccgtttttgtgtgaacgtccatatcgttcgtgaacgcttcaatcaaatttttatcctttgaaatgtgggcgagaaccctcagctcgatctgtgagtaatccgccgcaaatatgagccagcctttttgcgaagggacaaacgcctgccggattttgcggccctcctcaaggcggatcggtatattttgcagattcggatcggttgagctgagccttcccgtctgtgttaaagcttgattaaagcgggtatgcactttatggctgtcttttttgatcactttcaaaagcccttctacgtatgtggactggagcttgccaatctgcctgtagtgcaggatatcttcgataatgacatgtttatcgcgcagcttttcaagcacatcggctgaagttgaatagcccgtttttgtttttttgacgacaggcagcccgagtttttcaaacaaaatcacaccgagctgctttggtgaattaatgttgaaggtttcacctgctgactcgtggatttttttctcgtattccgctaatttagcggacagttcttcacccatttttttcagtctgtcgacatcgacttggacaccgatcgattccatctcaccgagaatgtgggcgaggggcatttcgagcgcttcaaacagttcgagctgctcgttttcttccagttcatcaaggagcttttcgcgcagcagcgatatcgccttcgcctttctggctaaatggtcggcaagctccttctcatccggaaccgcctgtttcgctccttttccgtagaccgcttcatctgctgaaacgatgtgtaattgatgttctttcgcaacgcttgccacatcatcgtaggagtgccccgggttgatgatataggccgcaagaagaacgtcaaactcagcgcctttcagttcaatgccccgccagcgcaaagcgaccgccgcacgttttgcatcaaacacccatttctttttcgactcatcttcggcccattctttaaaacggtccgactgaacggccgtctcttccggaatgaagaaagcgccgtgttcgttgacgatcgaaaaaccgaggatcggcgcctcgtgataattgtcgccgagctgttcgactacgagtgaagccggtgacgcaaacaagtcatccgtgatgtctgttttgatcatgacatcgatctcttccaactgttcttcttctttctctcccgcctcttcgccaatcctttcgagcaaagaatgaaagccgagatctttaaaaatcttgacgaccgcttccctgtcaaaaccttcatatccgagggaatcgaggctgacttcaagcggcgcttctgtcgtaatcgtcgcaagctctttgctcatcaaagcctgttctttaaattcttcaagcttttctttcagtttttttccgctgacttcgtctattgacgacagcagctcctctactgtatggaactgtttcaaaagcttgatcgccgtcttttcgccgactcccggcacgcctggaatattgtctgacgagtctcccatcagccctttcatatcaatgatctgttcaggggtaagtccgtacttttcccggacatgttcaggcgtatagtattcgacatctgtaatgcccttttttgtgatggcgaccgtcgttccttctgtagccagctgtgtcaggtccttgtcgccggaaaaaatcttcacttcaaatccgtctttttccgctgatttggcaagggtgccgataatatcatcggcctcgtagttttcaagctcataccttgagattctatatgcgtcgagcagctcgcggataaacggcaattgctctgacagctccggcggcgttttttgtctgccgcctttatattctttaaacgttttatgtctgaatgtcgttttccccgcatcaaaagcgacgagcatgtgggtcggtttttcctcttcaagcatcttcattaagatcgtggtaaaaccgtacaccgcgtttgtatgtatccctttttcattgctgagaagaggcagggcgaaaaacgcacggtaagccaggctgtttccgtcaaccaatactaatttttttctttcagtcatctttatcctcctaaggagccgattcgtcagcttccattcaacttcgtgatcatatttgcttattttattttagcaaagttcattttgaaaggaaaatgagagtgatttcgcagaaaaataaaaaaagggacgcgctgttgatcgcgtccgtccatatggctccttggatgaaggggttcactaatgatcctatcagccaagttttaaccatatatataaaagttgttaagcctttgtaaagtttgctaaatgaagctactcggatgcgcgttttaagcggaccgtgaattcggtgccttttccccgctcgctttcgacgtcgatttcgccttggtgggcttcgactaaatgcttgacgatcgcaagaccgagaccggttcctcctgaatttctgctcctgtctttatcgatcctgtagaaccgttcaaatatcctcgggatttcggactgcttgatcccgatgcccgtatccctcactttgacttgcactgcatcttccagaacatcagccgaaatcgtcacgcttccatcttcaggcgtatatgtgagcgcattgttcaccaaattcaaaaagatctgctttagtctgtgcgggtctccggaagcaacggccggcttatccggcttttccagtgtcaaggtgattcctttttcctccgctttattcttcaaaagcatctcaatttcggcgaggatttcaccgatattgcaattttgaatattcagggtgaagttttgctgttcgattttcgacagatccaacaggtcctggatcaaggtttgcagacggctgctctcttttaagatgatcgatagaaactgcaacagcgtctcccgttcgttcatcgctccgtccagaagcgtttcggtgaaccctttgattgatgtaatcggcgttttcagctcatgggagacattggcgacaaagtccttcctcatttcttcaagctgctttctttccgtcatgtcatggaaaacgagaacgatgcctttccactcatcattgatgccgataatcggaaccccgtcgacttcaaaataccttctttcaattttgatcggcagtttaaacattttgcggacctttgtttccgtcataaaaatttcttcaatgagattaatgatctcttcgtgttcgagcacttcgtgatagaaatggtaaagaagctgatcggcttctacgtgaaattgcttttgataagcgcggttcacaaggtgaatataaccctttccgtcgattaagatcagaccggaatcgatattttcgatgacggtttgcagacggtcgcgctgcatttcctgggctcttgtcatgtcctgcaggttctgcgccagcatattgatggactggctcagcatcgtttcatcttcgttgaatgttcttgctttatagtttcctttggcaagctcaatcgccacttgtgtcgcagactcaatcggattcgtatattgagaggttattctcgccccaagcccggcgatgattaaaaaggccgttccaaggctcacgccgaggagaatccagatcttttgattgatgtcttgcaatgaatcgacaggagtgctgatcagaatatatccattcacattcccgtcatctttgagcggctgcacgtaacggtaaacggactcgtcatcagggttgatcctgaagcctcctccttcaccgtttaaatccgactcaagcgcttccttgataacggattgctcttcggcgcggcccccaaaatgaaaaagaacctgaccttttgtatcaataagcgatacacgactgtccagttcacggcttgccttctctaaaatagctccttgctccgaagacttcatgttttcaccatttgccaatgaagcgaccaaagcggcctctttttcaatatggctgctcagtttggcatcgtaagaggagtgaaacaagtgaacgagcagaaaaccgagtgaagcaaatacgagaatcaaaagcgtcagcagggcagctaaaagccgggtccggaatttaatcattcagtttcggctcctccattttgtagccaagacctctgattgttttaatgtattccggtttttttgtatttttttcgatcttatcgcgaaggtggctgatgtggacatcgacgatgcgcgtatcgcccgcgaagtcgtagttccagacagcgttgaggagaaggtctctcgtcagcaccctccctttatgccttcccaaatataagagaagttcgaattccttcggcgtcagctcgaggcgttcgttttgaaaataaacctcataatgttcaggcagtattttcagttcgcctatgatcagctcgcctgcatccggttcttccgtctcctccggctgaacggacagcgtctgtgttcttcttaaaatcgctttgacccttgccgtcacctctctcgggctgaacggctttgtcatatagtcatcggcacccagctcgagaccgagcactttatcaaattcatcatcctttgcggtcagcatcaaaatcggatacatcagcttcttctgtctgagttccttgcatacttcaatgccgtccattttaggaagcatcagatcgagcacgatcagatccggcttctcttcaatcgcctttaataagccggcctctccgtccatggcggtcaccacatgatagcccgaccgttcaaggttatattttagaagggtaacaatcgattcctcatcatctacaactaatatctttttgctcatgacatgcctccaggcttcagatttccccgacatctctttctctatcttttgttaaataaacgttttcactcctattttaacgaaagcctatccgttcgacaatttgatttttcagtgttttgcttaaaatctctctttttcggccataagccgctgttttaagtgatggaatccccatgcagccagcggcctccatcaaaaagaatgaaaatgtccgggcagatgattatgattaggtatatgctgacagcccgtgtttatgtcttgtttcataccgtcttatgtaaaaggttcgcattcaaaaacaggaaggcttgtataaagccttcctgccgtgtttattatgataatactttcatgacgtttttgactgattcaacggatttatcgagctgacttttttcggtttcagtcagttcaagttcaatgatctgttcaagaccgtttccgccgataatcgtcggaacgccgagataaatgccttcatagccgtattcgccttcaaggtaggcaatggtcggcagcacgcggcgctggtcttttaagattgcttcaaccatttctgtcagggaagcggccggcgcatagtacgcgcttccgtttcctaacaggttgacaatttctcccccgccttttctcgttctttcaacaatcgcatcgatccggtctttcggaagaagcgtttcaagcggaatgccgcctgcataagagtagcgaacgagcggaaccatatcgtccccgtgtccgcccagtacaaaacctgtaatgtctttgacggaaaggttgagctcctgagcgacaaacgttctgaatcttgccgtatccaaaattcccgactggccgatgacccgctctttcgggaagcccgattctttatagacggcgtatgtcatcgcatctacagggtttgtcagaacgatgatgatacaatcaggtgagtatttaacaacttccttcgttacgctcctcatgatcttttcatttgtagccacgaggtcgtcccggctcattcccggctttcttgcgatccccgccgtgatgacgacgatatctgaaccagccgtatcttcatagtttgccgttcctgtaatattcgcgtcaaatccttggacagggctcgcttccagcatatcgagcgctttcccttttgtagggttttcgagctgcggaatgtcgactaatacgacgtcggccaattctttttgagccgttaaaaacgcagttgttgcacctgtaaaacccgctccgatgacagatactttatttcgcttctttcccattttttctaccccttttaattgttgtttgttttaccccaaaacagccgtttaagacatgtttttgataagctcatcaccgaattcagagcatttgacttcagtcgcgccgtccatcaaacgagcgaaatcgtatgtgacgactttggatgcgattgttttctccattgatttaatgacaaggtcggccgcctcattccagcccaaatgctcaagaagcagcacgccggataggatgactgaagacgggtttactttgtcgaggccggcgtatttaggcgctgtaccatgtgtcgcctcaaagatggcatgtcctgtctcatagttgatgtttgctccaggtgcgatgccgattccgccgacttgggcagccagcgcatctgaaatgtagtccccgttcaggttcattgtcgccacaacgtcaaactcggcaggacgtgtcagaatctgctgcaggaagatgtcggcgatgctgtctttgatgatgattttgccggcagcttcagcttcgctttgcgctttgtttgcagcgtctttgccgtctttttcagcgatgcggtcgtattcggcccaggtgaatactttatcaccgaattctttttcagccacttcatagccccagtttttaaaggcgccttccgtgaatttcatgatgtttcctttatggacgagcgtcacagatttgcggccgtgctcgatcgcatactcgatcgcagctctgacaagccttgatgttccttcttcagaaaccggcttgatgccgatgcccgatgtttcagggaagcggattttgttgacgccaagctcgtttttcaggaatgaaatcagcttttgcacttcttcagagcctttcgcatactcgatgccggcgtagatatcttcagtattctcacggaagatgaccatgtccgtatcttcagggcgcttaaccggtgaaggaacgcctgtgaaatagcggacaggacgcaggcatgtaaacaagtcaagctcttgtctgagcgctacgtttaatgagcggattcccccgcctacaggagttgttaaaggacctttaatcgcgatcaggtattcgcggatcgtatcaagcgtttcttccggaagccattcgccggttttgttgtacgctttttccccggcgtagacttctttccaagtgattttcttttcgccgttatacgctttctccacagccgcttcaagaaccctggaagccgctctccaaatatcaggacctgttccgtccccttcaataaacgggatgaccgggttgtttggaacgtttaatactccgccggagactgtaattttttcgccttgtgccacaataaaacctcccataatatgtaattcttcaatatagaaaaacatttgtttcccccgtttggcgggggacaaacatgttttttcatagattcattaattcattgcttccatagaaaagccgttgagaggccggccgaacgaagctcgagcagcctcttttcaaacggtcagcttctttcttcaatcggaatgaacgtctgcatgtcagggccggtgtagtcagcccgcggacgaatcaggcggttattttcatactgttcaagaatgtgagcgagccagcctgataccctgctgatcgcaaaaatcggcgtaaacagatcatggtcgattcctaagctatgataaaccgacgcagaataaaagtctacgtttggcggcagctttttctgagacgtgacgatttcctcagtccgctctgaaatctcataccatttgctttcacccgttaaattcgtcaaacgcctgctcatttccttcaaatgttttgcgcggggatcgccctggcggtatacgcggtggccgaaccccatgatcttttctttcttttcaagcttggcgtggatatatgaatctacgttttcaacctcgccaatctctgaaagcattttcataactgcttcgtttgctccgccgtgaagcggacctttcaaggctccgattgcggccgttatccctgagtaaacgtctgaaagcgtcgcgacgcatactctggctgtgaacgtagatgcgttcagctcatgatccgcatgaaggatcaaagctttgtcaaacgcttccacttcgacaggtgaaggttcttttccattcagcatgtagagaaagttggctgcaaagccgagttccggattcggctcgatcggctcaagccctttgcggattcttgaaaaagcagcgacaagcgcaggcatcttcgcttggagacgcaccgcttttctgtagtttgcttccgcatccatttgatctgcttcttcgtcaaacagcccgagtaaagaaacggctgtccgaagagctgccatcgggtggacttttccattcgggtaggatttgaaatggtcaatgacttctttggggatgccggcattttcagaaagctgttttttaagctcggcaagctcctctttgttcggcagctttaaatgccaaagcagataaacaacttcttcaaagctagctttttctgtcaaatcatcgatgttataccctacatatgtaagagtatcatcaataattgaacttactgatgatgtagtggcgactaccccttcaaggccgcgtgttgctgtcatactcatctctccctttttttaaaaatttccccttttaaaattaaaccaaaacccaggagcaaaaacaacgcatgacgtatacatcttctttaatccaaaaagaaaatgcttacattaaatcgtttttcaaataaaacaatcgtgcgtttctatataccgttcgatactccgatatgcttaataaagattaagcatatttatattataaacaattatcagacatttgttaaatgtttaactatagtttttttttcttattttttggcccagctgacttctatttacagattcttagtagttttaactgtattatttacatttaattatgtttttttaaaaaaatacggggctgaaatttttttagtagcgaaagtttttttcaaacaaaaaaaccccctgaaacagggggagcgcgcacatttctaagatgtgaaatgctggacggcctgcatgacaagataggcaatcccggcaccgatcagcgggccgacggcaacgcctttgaagaaagcgaccgctaaaatcgttccaaatacaagagcggtcgtgatatgcgggtcttctgcaagcaatgtgatcccgtttttggcgatcaatgctacgagaatgcccgctccgagtgcgatccatgcgtaatatgacttcatcgcttcgccaagctgtttaaagccgatctctcctgttgcgatcggcacaagaaccgcaattgtaataacggtaacgccccagttgatccctttggattggatggctggaaacagcttttgatcgaggccgatcagcttgatcaaaagcaggacggatacagcgatgatcaacgactgatttttcgcgattaaagcgatggccaaaagcaggatcaaaaataaattagcttgagtaaacatgctgtattcaactccatttttttatgacctttctcataataacaggacttaagaataaaatgaaataaggacatgctttctaatatcaggaggatgcagaattgaaccaatcctatcttacagctgcgcttcgggcagtgtatgtgctgtttttgaccgctgtttgcggagcggtcggctactactcttttccgttaacctatccttttgtgattgcgcttattctcgccatcatgatcaatccttttgtggaatggctcgataagctgaccgggttcccgagaggcgtcaatgtcggaatcgttctgttcggctttttgaccgccggagccggctttttgacactggtcgttgccgagatcgtctctggaacggcctatttggctaaaatacttcccctccagtttaataaagccgctctttatatcgaatcgttttttacgaatcaaatcatgccgctgtataatgagctggccgctttttttgacggccttgaagccgcccagcaggaatcgatcattacacaggtccaaaatttgggcagtgaacttgcttcaggcacggctttattgctttcaaaaattcttgagacggtgcccctttttttcgcctttctgccgaatatggcggccgtgctgatcttttcgctcctggccactttttttatcagcaaagatctgcataaaatacaaaacaaggcacggtctgttcttcctgatcgtctgatctcgggtgcagcggctgtctatgcagaattgaaaagagcactggcaggctttgtgaaggcccagcttacccttgtggcgatgacgatggtgctcgtgttgatcgggctttccgtgttgaaggtcaatcatgctgtggcgatcgcttttctgatcgggctggtcgacctgctgccgtatttgggaacagggtctgtatttgtgccgtggattgtctatttagcagcggccaaacagctgccgctggcgatcggccttggaattctgtacatcgtcgtacttgtcttcaggcagcttgccgaaccgaagattttaagccggtcaatcggacttcaccctttgggaacattaatcgcgctgtttgccggtttcaaattgtttggctttctcggattgatcatgggccccgcccttctcgttcttattcaggctctctttacaacaggtatttttagagacatatggctgtttattaaaggaaatgaaaaataagcggcagcctgcttttccatgcgggctgccgcttatctcgggttatttgataatgttgatccgcctgccttcagacattctcttcagcttgcgggagataaatggtttgaaacggccgcgcgttgccggcagcagcagcagtaaaccgatgatatccgataaaaaaccgggcagcaaaagcagcatgccccctatgaacatacaaagcccgtccaaaatcgcggccccaggcatctttccgtactgaagatcgcgctggactttgtagtagacttcgattccttgttttttggcgagagcggccccgagaaagcccgtcaaaatgatcagcaaaacggtcggcagcacaccgatccaattagcggacaagaggaacagaccgatttcactcgctggaaaaatgacgagaaataataagaaaaacttcatttttttcacctcataattctaaattggaagcgaacggccgccctattttgcttgtgccgcctgcaaaaaaagaagggaaagcttcccttcttccagcgtgttgtcaaaccctcgcattcgttgtcaggcctgcgcgtcggtgctcacgaattccaacattcgctccgctccgatgctcggccttcctagactgcaagggttttcaatcacgctgaattgaaggatgacaaaatcctaaaactgaaaaacgttttaggattttgtcataaatctaaaagaaggggaaagcttcccttcttcttcaataagcgattaaagcacgcttgcacgtcctttgtatacagctccgcgggcggagtcgaccgtgatgtcttctccctctttcagaatggaagtcgcattttccattccgacgatgacagggatgccgaggcttaagcctacgactgccgcgtggcttgttaagccgccttcttccgtaatcagcgcagccgctttttcaagggatgccatcatgtcacgatccgtgctttttgtaactaaaacggcgccatctttcatttttttggccgcttcttgtgcgttttgagcgatgactacttcaccaaatgcggatttgcgtccgatgccctggccttttgcgaccacgtctccgacaacatacactttcatcaagtttgttgtaccggcttcaccgacagctccggccgtgataacgatcaagtcgccgtggcgtacgatgcctgtatcgagtgatttttgcaccgctttttcaagcatttcgtcagtggagctgtggttttgtccgcttgttgcgaaaacgccgaacacaagtgacagctttcttgacaccgcatcgtttaccgtaactgcaacaatcggcgcctgcgggcgatatttggaaatcattctcgccgtatggccgctttccgtcggtgtgacgatggcattcacatcaaggttgattgccgtatgcgccacagattggccgatcgcatccgtaattgacatgctgacttgcttgcttcgtgcggaaaggatttttttatggttgagcgcttcttctgaacgggaagcgatattgtgcatcgtctgaacggcttcaacaggataatttcccgctgccgtttcacctgaaagcatgattgcgtcagttccgtcaaagatcgcattggcaacgtcgctcgcttccgcgcgtgtcggacgcggattgcgctgcatgctgtcgagcatttgggtagccgtgatgacaggcttgccaagcgcattgcattttttgatcagttctttttgaacgagcggcacttcttcggcagggatttctacacccaggtctccacgcgcaaccatcagaccgtctgatacttcaagaatggcatcgatgttgtcaacgccttcctggttttcgatttttggaatgatttgaatatctgccgcattgtgctcttcaagaagttcgcggatttcaaggacatccgacggacggcgcacaaaggatgccgcgatgaaatcaacgccctgctcgatgccgaatacgatgtcgtttgcatctttttccgtaattcccggaagattgacgctgacgcccggcacattcacgccttttttgtttttcaacgttccgctgttcatcactttcgtgacgatttcacgcttgtccttgtttatgtcagtgacttcaagtccgatcaatccatcgtcaagcaaaatcgttgaaccgactgacacatcgtgaatcaacccatcatatgtaactgagattttatcaggcgtaccgatggcttcgtccattgaaacgatcagctgagaacccgctgccagttcgatcgaaccgttttccattgtgtgcgtgcggatttcaggccctttcgtgtcaagaaggatgccgatatcttttcccagcttgccggctgcttcacgaatgtttttaattcttgcgccgtgctcttcgaaatctccatgggaaaagttcaggcgcgccacgttcattccggcttccatcagctgggtgagcttttcaacactttcgctggccggtccaattgtacaaactattttagtctttctcatattgcttcctcctcgggttttacactagattgacagttcttgagacaagcggtacatgctttgatcaattgtatgtttttgctcgagtatttcaatgatatcatgatgcacaagctggttattttgaattcctacacaacgtccgccttttccttcaagaagcagttcaaccgcaaatgcccctagacggcttgccaatacgcggtctgctgcagtcggggaaccgccgcgctggatatgtccaagcaccgatactctagtttcgagatttgtggcttcttcaattctttttccgaattcaacgccgctgccgacgccttccgccacaatgatgatgctgtgtttcttgccgcgctcatgccctcttttcagccttgcaataatttcttccatatcgtagtcggcttcaggaatcaaaatggattccgcgcctccggccaaacctgaccataaagcaatgtccccggcatggcggcccattacttcaatcacgtatgtacgttcatgggatgtagctgtatccctgattttatcgatggcgtcgataacggtatttagcgccgtatcgaatccgatcgtcagatctgtgcctgggatgtcattgtcgatcgttcccggcactcccacacaaggaaaaccgtgttctgtgagctttttggctcccatataagaaccgtcgccgccaatgacgactaatccttctataccatatttttttaaattcgctattcctttttcccgtccttctaccgttttaaactcaggacaccttgctgtatatagcttcgttcctccgcggtgaatgatatctccgacagaaccgatttcaagcttttctatttttccgctgattaaacctgaatacccgttgtaaattccgtatacttctacgtcatggtagatcgctttcctgacaaccgcgcggaccgccgcgttcattcccggggaatctccgccgcttgtcaatactccgatacgtttcatctttttcacctcgaaaacatatataatttaccttaacacgttcattgccgctaaaacaatgaaaaagggatgaaagttttccgaaaatccctataaaaccttactcattatacaattaaacaaaaagtttttaaataaattttaagcaaactctttgaaaaatcgcgggcggcagacacaatcctttcacttttcaccttcacccataaaaaataaacgtgagccaaaggcctcacgtttatttattttatcccaacatattggttttcagtcgaaatttttccaattgacttatacttgttatatctttgttggatcagctcgttcttatccagtttcagcagggatttaagctcgcctttcagcgcttcgtcgatgtaggcagcctgctgctccacatcgcggtgtgctccgcctcttacttcttttataacatgatctataatatccaattctttaaggtccggagcggtgattttcattgtttctgccgcttttttcgcgagtcctgaatccttccagaggatagcagcagctccctcgggagagatcaccgaataagttgagttttccagcatcaataagcggtttgcgacgccgagcgcaagcgctcccccgctgccgccttccccgatgacgatcgagatgaccggcacggagagtcccgccatttcaaaaagattcttggcaatcgcttcgctttgcccccgctcttcagctgctttgcccgggtatgctccttttgtatcaataaagcagatgatcggcctgttaaatttgtcggcctgcttcatcagcctgagcgctttgcggtagccttcaggatgcggcattccgaaattgcggcggatgttttcttttgtatccttgccgcgctgctgaccgattactgtcacaggaagaccccggaacttggcaattccgccgacaattgcttcatcatcaccgaaataacgatctccgtggcattcaaaaaaatcggtaaagagatgttcgatataatcgagcgttgtcggacggttcgggtgccttgcaatctggactctgtcccaggctttcagatttgtataaatgtcttcttcaagcctttcaagacgagcttcaagcttcgtaatttcagagctcaaatccatatcggaatcctgtgtgaactttttcaattcggagatcttttcacgcagttcgaccaccggtttttcaaattctaattctccagccactcgagatcacctccagtttggtgcattttcaaaatgctgccgagcgtttttttcatgtcagctctgtgaacgacggaatcaagctggccatgctttaacagaaattccgcagtctgaaaatcctcgggcagttcttcacggatggtttgttcgataattcttcttccggcaaagccgatcagcgcgcccggttcggcaaggttgtaatcgccgagggatgcgaagcttgcggatacgccgcctgttgtcggatgcgtcatcactgaaatgatcaagccctgctcttcgctgaacagcttcaaagcggagcttgttttagccatttgcatcaagctgagaaggccttcctgcattcttgcaccgcctgatgcggtaaaaatgatgaaaggtactttttcttctcttgccttttcgattgcaagcgtaattttttcgccaacgacagatcccatgcttcccattctgaaagatgaatccatcacggccacgaccgccggagatccgtcaatcgtccctttcccggtaacaaccgcttcattcagcgacgttttttcccggtctttttgcaatttttcaaggtatcccgggaactccagcgggttttcagacatcatatcctgattgaattcttcaaaggagccatcgtccagcaggctttttatacgctgcttcgcgttcatttgaagatggtaaccgcaattcatgcagacccttaaatttttatccagctcttttgtgagcatgatttttttacaatccgggcactttgtcatgatcccttccggtacatcttgcttcgctgattccgcgggaacggaagcgtatttttttttctttttgctgaatatatcttttaacaaaagattacctcccttttctgaagggttttcttcatgtatgcctgtcctgtttatagactagaacatcactataccgaaactattgtactttttttgtcaaacggtgtcatcctcaattcgacatttttgaccggcaaacagccgaatcgcactttatgcggttagagactgacaaattgatatatcagccttgagagcggatacaaaagtccggaaaagcgatttgaaaaaaattttcacagcccgaatatttccttacaagtgtccccaataagaggaaaaaccgaacatcatattcgataaacagcgcgtgacggctctttaggccagagcaatcacgcgctgatcaaaaatggacttttatttcccttcaatcactgcaagctttcttgttttttcagcgacttcttctggatcgacatcgattcgtgcaacgcctgtttccatcgcggctttggctaccgctttggcaacagctggtgcgacccttggatcgaacggagccggaatgacatattcaggtctcagctcttcgtcggaaacgagtgacgcgatcgcctcaaccgcggcgattttcatctcctcgttgatatgtgtcgcgcggacgtcgagcgccccgcggaagatgccaggaaaagcgagaacgttgttcacttggttagggaagtcagagcgtcccgttccaacgacgcttgctccggcttcatgcgcttcggcaggcatgatctcaggatttggattcgccatggcgaagatgatcggtttgtcagccatgctttcaaccatttcttttgtcagagcgccttcgacggaaaccccgataaagacatcggcgtctttgatcacgtctttgagcgaaccgtctatgcggtttttgttcgtatattttgcgacttcttctttaactgcgttcatgccgttcggacggccttcgtagatcgcgcctttcgtgtcgcacatgatgatgtcgcgcacgccgaaatgataaagaagcttaatgatggcaattcccgctgcgccggcgccgttcgccacaactttgacggaagacatcgttttgccggacagcttaagcgcattgacgagaccggctaccgttacgattgctgtaccgtgctggtcatcgtgaaacaccggaattttcgtttcttttttgaggcgttcttcaatgacaaaacagtttggagctgcaatgtcttcaaggttgacgccgccgaatgtcggctcaagcagcttgaccgtctcaacaattttatcgacatcagatgtatttaaacagattgggaaagcgtccacaccggcaaagcttttgaaaagaaccgcttttccttccatcacagggagggcggcttcagggccgatattgccgaggccgagcacagccgttccgtccgagacgactgctaccatgtttcccttcattgtataatcatatactttgctgttatcatcgtaaatcgctttgcagggttcagccacacccggagaatatgcaaggcttaaatcgtccgcattgcgaacctgcacttttgattttgattccaatttgccctggtttactttgtgcatatgcagtgctttttctttcaatgacatgttaacaaacactccttcaagggaattttgccaaaaactttgcttcgttttctgcttaagattcttgtaagacgaaccccagaatcttaaaaatgataacacaactgaccgcatttttgatcaaaaatgctcaggatacctgctatctgagcacgacatttttctcacctacaacgcttttaagcctgtatagagcagcgtgatcagccttgatattatagctttccggcagctgcatcgtctgcttccgtttttcataatagacgcagaccggcgtttcccctttgtgttcaagcaggatgctgctgatcttcttgaaaatatcgtgggtgtgctggctttcctccactttaatatagacggacggctgctttttcgcatgaagcgattcgacgagcgatgccccggaaataatcagctggcgtttttcattccttgtctcaaggcgtccttctgcaaaaagcgatacgccttcttccaggatcggggaaagctgcctgaactgttcaggaaaaacaaccgcctccatttccccgctttcatcgctcagctccagaaaagccatcgtctgtcccgtttttgtgcggatcgtcttcatcctcgtcaaaagtccgcccagagccgcttttttgcggccggaggcgagcagctgaataatcggcagcgcacctgcacggtccagtttcttgcggtggacgctcagcggatggtcagaaaagtaaatgccaagcgtttccttctcgtgtgccagcaggtcgacgagcggcatttcctccgtctcggcgtacttcggcttgattgtcaagccttcatcgagaaagaagcctagctgatcattgtctcctgcaaacaattcggcatgctccagcgcgacatcgacagaagcgagcaaagtagcccggttttcaccgaattcatccattgctccggcaaaaattaaggcttcaatcgttttccgatttacgcttttcacagaagtcctcacacaaaaatcaaacaaatctgcgaacggcttttcttttctggctctgtagatctcttttacagccgctatcccgacgcctttaacagctcttaaactgtagcgcagcgccccgttttccacgacaaacggatagccgctcttattgatggaaggacctagaacattcagccctttcccttttgcttcatagatgtactgagcaagcttttcctcatttccgatcgcactcgtcaagaggccgcacataaagtagaggggataatgcgcttttaaataagcgagctggtagccgatcatgctgtatgcaacggcatggctccggttaaaaccgtaattggcgaatttcacaatcagatcgtatacttcattagccgcctgtacggaatatccttttttcaaacatccactaataaaatgatttctctctgtatcgagaatttccttgttttttttgccgaccgcccttcgcaaaaggtcggcttctccaagcctgaaacccgccatccgggatgcgatcatcatgatttgttcctgataaacgatcacgccgtacgtatctttcaggatatcggccaaatcctcgtgcggataagacacaggaacccgtccgtgcttcctttcgatatacagcgggatgttttccatcgggcccgggcggtacaaggcattgacggcgacaatatcttcaaggctcgatggcttgagcctttttaaaacgtttctcatgccggctgattcgagctggaaaatacctgtcgtgtctccttcagccagcagcttaaacgtctgttcatcatcatagggaatcgccgagaaatcgatagtgacccgctcgcttttttcgatcagcgttttgatcgattcaatgagcgttaaattgcgcaagccgagaaaatccattttcaaaagtcccaagtcttcgagatagcccatcgaatattgcgttaaatatacgccgccatgaccttcctgtaccggtatgatattcgtcagcggctcctcgctcaatacgacgccagccgcatgaatggacgtatgccggggaagcccttcgattttctgcgccgttttaaatatgtcctgaagcttttttgagccgtttaggcgcttgtcaagttcaggtgaaagtgctctcgcctctttcagcgtcactccgggtttggagggaatcagcttcgccagctggtcggcttctttcggactgatgcccatcaccctgccgacgtctcggagcgccgcttttgcggccaatgtaccgaacgtggttatttgtgctacgtgcagtgccccgtacttatttttcacgtactgaataacttcatcccttctcgtatcgggaaaatcgatatcgatatcgggcatgctgatgcgctccggatttaaaaaccgttcaaacagcaatttgtgcttaagcggatcgacatctgtgataaacagcgtataagcgacgagagaaccggccgccgatccgcgccccggccctgtgataatgccgttatcgtgggcgaacttcatgaaatcccagacgatcaaaaaatagtcgctgaaagccatgtcgcgaatcactttcagctcatacttaagccgctcgacatactccttcggagcggcttcgaaccgttttttcagtccgagaaagcaaagctcggccaaataatcgtcggcattcttgccggaaggcgccggatatttcggcaggcgcgtctggccaaggctcaggtccacctggcatcggtccgcgattttgactgtattctccaacgcgtccggacgatctctgtaaatgtccagcatttcagcgggcggcttgagctcaagatgcagatctccttcggccttcatgtcttcgttcagcttctcgcccgctttaatcgcttttaaacacgtgtaagctgccgcgtcctccttttcgatgtagcgtacatcgccggttgcggcaatcggaattcccgtatgttcgcttagctctaaaatgcgttcagaaagaagcgggtctcccttgtacggctgatacgacaaatagaagctgccctctccaaagatcgaaaggcagcggagggcagcgtccttcgcctcttcgatcagcccttctttcaacagcgcttcaacatggcttgtcccgcccgttgtcagcgcgatgaggccttcatgatagcttttgagccatttttccttgatgccggtttttgattttgactgcaacacgctgctgattttcagcaggttttgatagcctttgtttgttttcgccaaaagaacgagcggatatgatagctgctctttttcatctgttaaaacagaagccgtcagcccgataatcggcttgatgccgcgttttttgcatgatttataaaattccaccgccccgtacatgacctcgtcatccgtcagcgccattgcgctgtagcccagctctttggctttggccgtgagatcctctacggaagcggcgctgtttaataagctgtaaccgctatgtacttgcaggtgaacaaaaggcatttctgtcaccccttcctttttcgagccgtctcttttcattatatgatgggatcgaatgagaaacaaatgttctttctttgatcaacaatcatacttgtctttctttatccatatagtgtgataaggtgaggtgatcggaatggatcctgaacagccctttttcccaaactttatcagctgttattttattgcgcttggagtgcttctcggcggttgtttaatcggggggatcggcgcctatctgtcggggcagccgcctttaacgatcattacaagtctcgcaaaccgcctgaaaatctgggcgctggttgcggcaatcggcggcacgtttgatgcggtctacagctttgaaaggggcattatcgaaggcaatacgagagacatcgtaaaacagcttctcctgattctttcggcgatgggaggagcgcagaccggttatctgatcatcaactggctcacacaggagcatatttcctcatgagaatccctccatattataaaaagcctgggtggcagcgtttttttgcgggaatgatgtgcggagccatcatcagctggttcgtgttcctgtttacatacggaacctttcaggagaagcaggtcgtcttgatcagggaacagaaagagcgcatcaatgatttaaatgaccagatcaccatttaccgcgaggatctgcataagctgaatgaagacaataaaagaaaactgctgattcaaagcgtcgacgtcaagctgatcaacggcaagcaatacaagctgtcacagccggacatgatgaactttgaggagcatatccgggataacatttcagatgtcattacaaaggatatcgaaagcgtctaccggacgaaggagcttttaaagcggacgattgaaaataaagagtatacgataaacgataaaaagtacaaggcgaaagtcaccgaactgacgatttatacgcggctttccgttgaaatcaaaatctctttttccgaataaaaattatggatttttttttacgattcacatgcattcgtcgcttttttccatattttaatttaaactgacagtaagcgatatgtaagtttttttaaaaagggaggaaagcagaatgtacatttacagttaccatcagctggcaagagataaagtcaaccggatcaagctgggctactcggcttatgcggaaactgaaagtctcgcgtcccttatcaaaaaagagttaaaggcccaaaacatccatgtttatgaggatgtaacagatatcggatcatggtttatacctgaataaacagcagctgtcgtgcgtaaaatgatccgcttacactttgctgctgtttacttttttgcaagatgtaatgcaaacgtttgcagttaaactgcacaaaaaagagggacttcccctcttatttgttttctttgcatatacgctccaggtcagcgatgacaagatcagcgtctttccagtcatagatggaagcgccggctgcgagcggatggcccccgccgttgtattttttagcgacttcattgacaatcggcccctttgaacgaagccttaccctgatttgatcggcttcctccacaaaaaacacccatgctttgatccccgaaatattgccgagcgtgctgacaagctgtgaagcttcagacggcgtaatattgtattgatgtaaaatatcgcgggtgatgaaaaccgacgcaacaccgttttcggacagagaaacattctggtaaatatagccgttcagcctcacaacatttaatttcgtctcatataattgatcaaaaagcgcctgggaagaaaaaggatactcgatcagctctccggcatatttcaatgtcttttttgtcgtgttcggaaataagaagcgccctgtatcccccacaatgccggcatagatcagttcggcgccctttgttggaagcgcccatcccgcttgttctttacccgctaaatacagttcgtaaatcatctcgctcgtcgagctcgcactcgtatccacccataaaaggtcgccgtaccggtcttcattcggatggtggtcgattttgatcagcttgtcgcccaggttgtagcgcgaatctgaaattctcgcttgatttgccgtgtcgcaaacgatgacaagtgcattttcatacaccgggtcttcaatcacatctggggtatacaaaaaagcgagagaaggttcaggagctccgaccgcgaaaatatttttttcggggtaggttgccctcaggatttccgtaaggccgcattgggatccgtaggcgtcaggatccggtctcacatgtctatgtataatgatcgtgtcatataatgatatggttctgatgatttcttttttcatgacgcgccccttctttactttgtttttaaccattaaatcataatctgttgttggtggaaagtgaaagttatgactttttattgtagaaagcgaacccgattatgtatacaatgggtttgtaaaacttacaatggaggatgtcgattatgccgttttttgttttttttattgtggtttcagcgatagcttatgtgtacttcaaagtaaggtatgtgcgcaccaaaaaagcggttgaacgggaatactattcggccaagtcaagcatgagtctgggcctgtttatcatgttcttcggcgccaatcagctgattttaaaccgcggcacgctggctgtcgtcatcggcgttatttttatgctgaccgggctcgggagcatgtgggccggctacaaggcctataagcactatgtccctttgcttgcgaaagaaaacgaacgggagaacgcataagcgaaaagagggacaccgaccgcgtcccttagcttctttccatcagctgaaccatcatcatcgctttgccgactagagcaccctggtgaaaaacttctatatccattttcccgaactttctcccggcttcgagaatgttcggttttatttcaatgacagactccatttgcacaggctttaaaaaataaatcgtcatgctctctatcacgagctcgccttttttgcgcgaccgcaaaaagcggtttgcagcttcggtcaaaatcgtcgtaaacacgccgtaggaaatcgtccccaagtggtttgtcatttgcggcgttacttcgtattgatagaccggagccggcttgtttttgtcattgtccgattctttgaaaccgccggtcacgatgtcatcgagtttttctccgacctgcggctgtttttggatcatttgaagcgcctttaatacatcctgcctgctgatcatgccgatcagcttttgccgctcgtcaacgacgggaagcacttcgatcccttcccagaccatcatctgcgcggctgaagcaacagacgtttttccgatcactgtaatcgggtttttcgtcatgactttttcaatcaatacactgcggtcatatccggcaacgtccttcgaagttaaaatgccgtggattttcatctgctcgtcaacgatgggaaagcgtccgtgcccagtttcaaagtttttctcataccatctttccagcttttcatgaggtgataagcagactgttttttctaaaggagtcaaaatatcctcaacaagcacgacttcttttttgatgagctggtcataaatcgccctgttgatcatcgccgctacagtaaacgtatcatagcttgtagaaatgaccgggagctcgagcctgtcggcaagctcaataatctccggctccgtatcaaaaccgcccgtcaccagtacggcagcacccgcttccaaagcctggcggtgcgcatcgattcggttgccgacaatcagcaggttgcccgctccggtatatctcatcatcgcatcaagcttcatcgctccgatgacgaatttgttgagcgttttatgaagccctgcttttccgccaagcacatggccgtcaatgacattcaccacttcagcatatgtcagtttttcaatattctcttttttcttttgctcgatcctgatcgttccgaccctttcaatcgtgctgacaaaccctttattctcggcttcttttatcgctctgtaagcagttccttcactgactttcatttctttggcaatccgcctgacggagattttttcgccgacagacaaagaatcaatatattttaaaatctgttcgtgttttgtcgccaatcgtttcaccttcatcctctgactgctagatatatttattataaatcgttgtgcgattgaaccgcaatccgccttcacaacatcatgcccgcctaagccttatcatcctccatcaggagaagcgctttttcaagccatgagcaatagcctttttcccgctcaagcgcccgggtcaatacaaggtaatggccgaaatgaggcgagcggaacgttattgaatcacccgcttcgcgcttcaattcatcgagcttggtgtttaaaaaagcagctttttcctgtctcttttgaagctgatcgttaaaaagccttttcgcttcatcaggttccatcgaagagataaaataagctttcagcataaattcatcttttaccgtatctggaaccggcttaaattccgtaagccacccgtgaagttcacgctttccggcttctgtgatggaatacattttcttttctaattttgagccttggatcaccgtttcaaattcgataaatccttcatccgtcagctttttcagctcgggataaatctggctgtgcttggcgctccaaaattggcccaattcggctttaaaccggcttgtcatatcgtagccgctcaaactcccatgatcaaggagccccaaaatcgcgtatttcaataccctcataatcaccctccaagatgaatccgattcctacattatatcatggtggacatgttttgataggcgcataaccggttcaaccgaaaaaaggacccggattcgggccctctaaaacaaatttacttaaattcgattgactcaccgacctcaagcacttttccgacgcctccaggaaggctgtccgcaaatgcatgcggatcctgttcgatgacggggaacgtcgagtagtgaaccgggacaacctgtttcgctctgagccattctgcggccagtttggcgtcctcagggcccatcgtaaaattatcgccgatcggcaagaaggcaaggtcgatatgatttaattcaccgatcagcttcatatctgagaaaagcccggtgtcgccggcatgaaaaatcgtccttccttccacagtcagaaggatccccgccggcatgccggtatagacgatcttttggctgtcttcttccgtataagccgatccgtggaaagcctgcgtcagcttgacttttccaaaatcgaactggtgggagccgccgatgtgcatcggatgtacattcaggcctttccatcctagatagaccgcgagttcattcggagctacaacgagcgaattgtttcgcttggcgatttcgatggtatcgccgacatgatcgttatgtccgtgagtcagcaagatgacgtccgctttgacatcttcgggctttaaatcggttaatgagtttcctgtaataaacggatcgaagatcaactgatgatctcccgtatcaactgttaccactgaatgaccatgatatgccactttcatcatatccacccctgatttttttaatttcgcacgtctagagagaatgacggttaatcacattcaagccgcctgtggcttcaatgactgttcccgtaatgtagtcggaatgttcatcgcatagaaaagtgatgatccttgcgatgtcttcaccggttcccgacctgccgatcggcgtttcctcatcaagtgacgccctcgcttctgaaatcgaggcctctttcatatccccgacaatgttgcctggacagaccatgttggctgtgatgccggagcccgcttcttcaatggcgatcgtctttgttaaagaagccagccctacttttgccgctccaaaagcggaacgatgcagccagccaggcgcatggtcggccccctgaaatccgtaagtgatgattcggccgaaccgctggcgcctcatgatcggaacaaccgctttaaacagatggaagacagagcttaagttgccttcaagcatgtcataccattcatcatcagtataatccgcaagcttttttcgttcaaatatgtatgggccggcattattgatcagaagatcaatttttccaaatcgctcaagagcggcattcaccatccggagcaggtcttctttcctggtgacatcacccttaacaaactgcaaacggtcaagggatgaccgccatttttctttgaggcggcggacagcttcttcgtcttgcctgtaattcaccgtcactgagtagcctttttcaagcagggcttccgtcactttacgccccaaaccttttgaaccggcagtaattaacgcatggcgcacatctttccctcccaggcattggttctcggtattcgcaaatgattgcattaatctacctatactttactacaaaacccttaggatatcacatttggagcatcgggaagtttcaatcgccgctggaatacaatcgacagacggaagaaagctgaagcccgctcttacgggctccagctttctattgtttatctgcgtcagctaacggctgtgcgtcatcgtgcgcgacaaacccgctgaaataagcatcagagatctgctgaacggtttctttatctccgtcggcatcatacatatatccgtgttttgactgatcttgtttcattgccacaccccttttcgattcacaaatttattttgcgtatgaagccgcacagttatgaatcgaatcgggaagtgttaaaaattgttcaaacactgcttcgccttttgaatggcttctgtcacctttttgaatcccgtcccgccttcgctcattcttttttcgacggcatggtgcgggtcgagcacgatgtagacgtcttcttcaaacagcccgcttgcctttttgaactcttcaaacggcaggccgctgagataaatgcccttttcgatgcaggtgaagacaagtcttccgacgacttcgtgcgcttctctgaagggcatgccctttttcgccagatagtcggcaagttcagttgcatttgaaaaatcctgctccgttgcttttttcatcatatttttgttcactgtcatcgttttaatcatgccggcaaaaatctcaaggcttccttcgaccgttttcacagtatcaaacataccttctttgtcttcctgcaaatctttattgtatgctaacgggagccccttcataatcgtgaggagtccgatcagatcaccgtatacgcgtcctgttttcccgcggatgagctccgccatgtccgggtttttcttttgcggcatcatgctgcttcccgtcgcgtaggtgtcatcaagctcaatgaatttaaattcctgcgagcaccaaagaatgatttcttcggagaatcttgacagatgcatcatcagaatgctgctcgcgcttaaaaattcaaggatgaaatccctgtcgctgacgccgtccaggctgttttcatatatcgaatcaaagccgagcaggtctgcggaatattcacggtcgatcggaaacgtcgttccggcgagcgccccgcatccgagaggagacttgttaatccgcttgaatgaatcatgatagcgttctttatcgcgctccagcatccagaagtaagccagcaaatgatgcgcgaacgagatcggctgggcccgctgcaaatgggtgtatcccggcagtatcgtctccacgtgttcttccgctttttcgatcataacgtgttgaaaagccgtaatcagctcgatgatatgctcagtgtgcccttttaaatacaggtgcatatccgtcgccacctggtcgtttcggcttctggccgtatgaagctttccgccgagcggcccgatttcatcaatgagcattttttctaggttgaggtgaatatcttcgcaatcgactgaaaaatcgagttcgtttttttccgctttgtgcaaaagggatgtcaggccttcctttattttgaccgcttctgcttcggttaaaatgccgcatttttcaagcatggaagcatgagcgagagaccctgcgatatcttcttttacaagcgttttgtcaaagtggatcgatgcgccgaactcatcgacccatttttccggtgttttttggaaccggcctccccacagctttttcatgctttaatctgctcctttttttggacgatgctgtttactttcgtcggcagtccccacagctcgataaagccgactgcagcgtgatgatcgaatgcatcgtcttttgtatacgtcgcaagcttttcatcatacagggagtattcggacttacgcccttcaacgatcgcatggcctttaaacagcttgacgcggacgacgcccgtgacatgcttctgcgtttctttcaggaaaccggaaagcgcgtctttaagcggagaaaaccagaggccgttatagatcacttcagccattttttgttcgattataggtttgaaatgcgccacttcttttaccaatgtcaaatcttcaagctccttgtgcgccttaatcaaagtcatcgcgcccgggcattcgtaaacttcgcgcgatttgatgccgacaaggcggttttcaacatggtcgatgcgccccactccatgtgcgcccgccagttcattcagctttaaaatcaagtctgacagcgggtagtgagtcccgtcaatggatacgggaacgccttcttcaaaagcgatttcgatcacatcaggagtatccggtgttttttcaagaggcttcgtcaaatcatacgctccttcaggaggcgcggcccaaggatcttctaggactccgcattcattgcttctgccccacaggttctggtcgattgaatacgggctgtcaagattgatcggaattggaatgccatgcttttctgcatacgcgatctcttcgtcgcgagaccatttccattcgcgcacaggtgccagcacctccaaatccggattgagcgatttaatcgacacctcgaagcgcacttggtcattccctttgcctgtgcagccgtgagccacggcttgcgcgttttctttctcagccacttcgacgagctttttggcgatcagcggtctggacagggctgatacgagcggatactttccttcataaagcgtgtgggcctggagggcggtcagcgcaaactctttcgcaaattcttcttttgcatcgataacataagaattagaggctccgacttgaagcgctttttgctgaacaaaggcgagatcctttccctctccgacgtcaaggcagcaggccactacatcatatccctgttcctgaagccactttatcgcgacagaagtatcaagtcctcctgaatatgctaataccacttttttcttttgcgtcatttcgaaaaactcctctcatctcggtgctcttttgtataaaaataagttttatttaataaaaatacatttaatatgtatacactttaacaaggaagtcttgttttttcaacctttttataaaaaaaacttcattcattttttatgaatgaagttcagtgcatattcagcgttcggccggaaggctttccggccttactttttcatatcttttctcagttctctgatgacatgggcaagctcaggcacaatcagctttgacattgcaagctttacggcaccgcttgaacccggtgttgcaaatacggctttgttttgaataacacctgctgcagcccttgagaggatcgcagccgctccgatatcctctgtataactcagcatgcggaatatctccccgaaccccggaatttctttcgaaaaaagaggaacgatcgactcgattgttacatctcttgaggcaatgccagtccctccgtttaataggacggcatcgatccggtcgtcgagacagcctttcagcacagctttttgaattatttccttttcgtcctttacaatctcataggaaacgatctcatgaccggcttccgctaaaaactctttcatgagccggccgcttttatccgtgtcttccgttcttgtatcgctgacggtaatgactttgcagttgacgcagtccggcgcttcttttttatgctcttcaacactcatggccatacagcctcctttatacagtcttttttcattataaaggggaaaatgtataaaaaaacagccctccttgaaaagagaaggctgtttttttatttttagtgtgccagtctgacgacgtctcttgcaatcattacttcttcattcgtcggaatgacgatgacttttacaggcgaatgcgggtagctgataaacgcttcttttccgcggacgttattcaaggcagggtcccaatagacgcccatgaattccaaaccatgaagaacgcgctctctgacttcaacgctgttttccccgatgccggcagtgaaaataatcgcgtctactccgctcattcgcgctgcataagaaccgatgtatttatgaattctgcttgcgaatacttcgagtgctgtttccgcacgttcattgccttctttagttgcttcaacgatatcgcgcaaatcgcttgagaatccagaaatacccaaaagaccgctcttcttattgagcgtgttcaggacttcgtcggctgtttgacccgttttttccataatgaacgggataagcgcaggatcgatgttacctgaacgcgtacccatcgctacacctgcaagcggtgtgaagcccattgatgtatcgattgatttgccgccttcaacagctgcgatgctcgctccgtttccaaggtggcaggaaatcaggcgaagttcttcaatcggacggccaagcagctctgccgcgcgttcagtcacatatttatgagatgtaccatggaaaccgtatttacggatgccgaatttctcataatattcatatggcagactgtacagataagattgttccggcatcgtttgatggaatgccgtatcaaaaacggccacggcaggaacattcggaagaacttctttaaacgctttaattccgacaatattggccgggttatgaagcggtgcaagctctgaaatctcttcgatctcatggatcatttcatccgtcaataaaacggagtcgctgaacttttcgccgccgtgtacgacgcggtgaccgattccgtcgatttcatttaaatccttgataatgccgaattttgtcagtttatccagcagcatttttacagctacggaatgatccggaatatctgttgtttcagtctttttttcgtcgttgacggaaatcgtgaagatgccgttatccagcccgattcgctcaacaaggccttttgttaatactttttcgctgggcatttcgaacagttgaaatttcagtgatgagcttccagcattgattgcaataattttggacataaaatgacgctcctttttacctatagtccggtgacattatgttcaacccggaacataaaaaatatgtataaaatcgttcttagtaaattcaaaaaatatctgcctttctcatttaaacactcaaaagagtgcatttcaagtcacgatccgacatgttaacgctttcactaagaaattattattttctgaatataaaaatagatcagagaatatatcttctctgatctgcttatcttttttcagcctggaaccagctgtcgagtttggctgtcatgttcagcatcgcatcctgattggcgaatgacgggacttgcgcgagcagaacctgtttaggcgctttcgcctgttccccatgcttttgtaaaaccaaaatgctcttcgcgtgtgcttcatctttgaaaatggacagcggaagctgaagcactgcattaatatgcgcattgttctttaaaaaggtacgcagcttttcgctttgaccgctttcaaacaaatggttcggaatcataaaaaataaatagccgcccggtttcgtataggtcaagctttgttcaataaacaaatggtgtgaaaaagagtggccttcatctgcctttaattcgaaagcgcgcgcactttcgtcatcaggataatatccgacaggaagatcgcagatgaccgcatcggcatgttccataaaaatcggctgcaggctgtcctggttaaaaagctcgatttccttttcctgcaggtttgcctggacataggccagcttgatcaggacgtcatcaatctctgagccgaacgcttttcccgcttcctcagccagctggttcaaaacggcaagcagcaggtttccagtgccgaccgccggatcaaacagcgtcaatccttttttccgctccataaatttgttcacaagatatccgataaataatccgatcgtatcgggcgtcatctgcctgttcggatgaggaatatctttctggcctttcagtatggcaagctggaaggctttccgtatcgactcatgactgcactctgaaaagcgcgcacggccgatcagatccttcaccttttgttcggcttcttcggaaagcccgcggtccgcagaacctgtaaagaatgcctctccggcttccgccaatccttctatgtaagggatctgccgatcgcgtgcgatgacttccgctcctttgtcaagccattcataaatcgtttcgactggatagttttgcatgatgatgtctctccttatcaaaaaatcaaagccatgaaaagagctccggcaagatgaacacctggagcccttttatgagttgaatttacttaacgagtgatttggcagcttcgatggctttgtcgtagtccggatggtttgtcgcttcgctgacgtattcagtgtagacaacttttccgttttcatctaaaacaaatacggcgcgggcaagcaatctcaattctttaatgtaaaccccgaatgcttccccaaaagacatctccctgtgatctgacaatgtttccacattttcaattccgtttgctccgcaccagcgcgcctgtgcaaacggcaggtcagcgctgatcgtatacactttcaccgaaccgaggcctgcggcttcttcgttaaagcggcgggtctgtgcgtcacaaacacctgtatcgatagacggaatcaccgaaataaccgccggtttgcctttgatgtcctgaagtgtgacttcctcaagcgaattggacaaaaccgtgaaatcaggcgcctggtctccgactttcacttctgaacccaccagtgtcaccgggtttcccttaaatgtaattgaagccatcatcattcctccttcatttatgtatgactctactataaaagagtttaggacaaactgcaaagcttaagtccggcagagacaaaaaaagttaactgctgcaggaacagttaacttctgggactctgttgccggaaagccggggcttttaaaaaggaggcgtctggttttgacggttcatattttgcttctgcttatcgtttttcttaaacatatgctgaatccgttcgatcgtttgcggagctgagtctaaaatcttatcgatgacgtgcgtgttttcatccaaatgcagtactttaacgcctgatgatccgacaatcaaaaaagcaatcggcgtaatcgatacgcctcctccgcttcccccgccaaacgggagcttcgattcttttcgttcgcggtctccatcgctcgctttggattcggccggtttattgccgccgaactcgcttccgccagccgcaaagccgaatcccactctggagacggttaggatgacgctgccgtcaggtgtttccacaggatctccgataatggtattgacatcaatcatttcttttaagttttccattgcggttttcatcaaaccttgaattggatgttcagccatattctattcctcctatactgatgaatcattctttgttgaacctgacagattttttggcagcttaaataagccgcgcattttccctttccagttcaccacgattctgaaagctgcggttatagcatgtccaacccgaaaatggaatatacatgtcagatgcgttttggaggaacggctgttaaaggctggaatcacctcgtattccggctggctgtcaaagcaaaaaagctgatgcaagagagccaccgtgccggctttcagggaccaggcgccgcctgtgacaatcccggttaaagccgcgtcaggaaagccgaggacagaggtccattcgagcttcgtgacgtgaatccgcttcataaaccggcggatgatcggctgcatattgatgatctgttccaccaattttttgatttgcttcgtactatcgaacacttcccgatagccgatttttctcctctttttatcttttttcagagccgaattcgtctgttctttcacatcaacggtcatatcctcctggttgattttaatcaccggaatctcccttttaatgcgcagaatgccaaaagccgtccgaactttgacggtcagccggtcgtcatcgtctgtatgaagatactcgatcgctacgcggattttcattatcatcaatgctgccaaaagaatgaatactcccgcaatccatatgtaaatcatgatttcacttcctcttatactaagcattataggaagaaaactggaaaaataaacatagccggaattccgccgatacaaaggaataaaaaaacccggcagtcttcagccgggtttaaaactctcagtctttttttcgatacagtttttcatggataaccgcagtgtccgcaaagaaatcgtgaatcccttgtttcttaggcgaaaacgctgctacgagatacgtaatatataaactgttgatatagcggccgataaactccctaaacaggaccacatcccatgtcagccctttttccgggacaagcgacacgaccttcagcccgaataccatcttgcccaacgtctgtccgaaatacttcgtcatcaggacaaagtaagcaaaaaatactgccgccgtcacaaaagaataaagcgaaaaggtgaaaaaccctgattctttagggaggttcagcaggctgaaaacgggtgaaaccgctaagttgttgatgctgccgataacaaccccgtcaagcagaaaagcaaacagcctgatccaaaaaccggcataggcatgctctacatgcggggccgattcttccctggaaacgccgacattcggcgataattcattatgatcctttccatcataagtcacatccattttttcggtcccctcctatttggcatataaatacatgagtctcggtgcaccggattgagaaatcgcttctttaatgtttaagaaatcagcttcgcttttaaacatcttatttgcagtcattgaaaacagcgaggcaaggccggctgattcttcatagctgacaacagatgcgccggcaaggtttttgtggtcctttttcatcgctttgaccgcatcttcataatagccgagctcatcaatgagatggttctgtttcgcctggcggccgtcatagacacgtccgtcggcaatttttttcacgtcattttcggacatgccgcgcccttcggcaataacatctacaaacccttcgtacgcgtcatcgaccattgactgcatgatttctctttcttttttcgtcatatcgcgcgtcggtgacatgatatctttaaactcaccgcttttaatcgtctccgtttttaatccaagcttctctgcaagcttgctgtagttaaggctttccatgatgaccccgagtgaacccgtcagcgtgtcaggcgctgcaaagattttgtcggcaggcgttgaaatgtaatagccgccggacgcagccatcgatcccattgatacgtaaatcggttttttcgtatcttttttgatctcttcaagcttcttatgtatctcagcgctctcgtatactccgccacccggagaattgacgcgcagaacaatgccctttacggcagaatcgtcttttgctttttcaagcatttgcaaaaacgatctgtggttgtagccttcagagctgaacaggcctgaagcgccgccattgtcggaaatcgttccgttcacttcaagaacggcgatttttcttgagctgtttccttgttcaagcaccgtttcttcctgggtgtcattgaggccaaactgcatctttccgtcattccccatcgtgtcaaatactgcaagcaaaaggctcatcaccgcagataacgcaaaaacgcccagcgcgatgacaagtgcgatccatcttttcgcattcattttgtctgttctcctcctttgaataaaaaagctgcatgtcttagtacgtatatgaagagaaaaagttcattatgatgccgcttcatatacaagaagtttttggacatggtaaactaagggtcacaggtcattttaacatatatgttagatggcagaaaaatctaaacttaacagacaaaggggagaatgattgtgacagaccgccgaaacatttatttcttttacaaaaaaagcgaagaaaccgacgagcagtgcaaaaaactgaaacagcttgccgaagaacacggatttcgcgtcgttcaccatcacaatgaagccaatattatcgcaagcatcggcggcgacgggacatttttgcaggctgttcgaaagacgaacttcagggatgactgcctgtacgtaggcgtggccaaaaaggggaaagctcatttgtatgcggattttaatatatatgataccgataaaatgattgaagcgacaaactcggagcaaatcgaggtcagaaaatatcctctgatcgatgtaaccgttgacgggaccagctttcaatgtctaaatgaagtatccatccgttcaagcattattaaaacatttgtaatggacgtctatatagatgatcttcattttgaaacattccggggggacggaatgatcgtgtccactccgaccggaagcaccgcttataacaaatcggttgatggggcaatcgttgatccgctgattccatgcatacaggtgacagagctcgcttcattgaacaacaacacatacagaaccctcggctcgccgtttattttaagcgcggatcgaaagctgacattaaaaatcgtccaggacgggaacgactatccgatcatcggccttgataacgaagccttcagtacgatgaatgtgaaagaagtcgaagtcagcctctccggcaagatgatcaaaaccattaaattaaaagataattcgttctgggaaaaagtaaggcgcacatttctataattttgaaaaccttttcattaaaaaagagcaagacgatcgtcttgctcttttttgcgaatgcctataacgaaattttcacttccgcattcatgccgggaagcaatttggcggacggattttgaatcgaaatcttgacttgaactttctcggtgactttcgtatagtctccgctttggttcatttccggaaacattgaaaataccgaatctgtcgcatatccgatctcttcgaccttcccttcaaacgttgtatcagggtccccgtcgactttgatgtccactttgtcgtctttttcgatatcgcgtaattccgtttctttaatatgagccgtaatatatatgttatccatatcggcagtttgaccgatgacaacccccgcatttacgattttatgattgacggctgtatttttgaccagtgttccgtcggaaatggctttgacagctaccgactgctgcccgtccgatatttttccgaggttgtcgccgtctgatatatggtcgccttcttttgcatcccagccgcttaattttccggaagcaggcgccgttatttttgtcatatttgcggaaacccttgcttcatccgtcgtgacataatgtttattttgataatagtaatatccgcatacagcgacaagcgctaaagttgcgataataccaatcatattgatgatcatcaaacgtcctttactcatgtttatcctatctccttttgttgacttgctgaagggtctggcaggcgaaggcgcttctgaacgagcgatcttccttttccggtcgctgcctttccaattgaagccgcaagcatgatgatgcttagccagagcagtatcgtaaacaaatcgtgatatgcgccaagggctgaagcttttctggcatttgcaacaatcgtataggccgccatgttcttcgcatcaccaacagaaagcccgctgctgacaaaatcacgaatcatttttgacaattccagctgaatttcaggatcagcttcactgatatgtcctcttatcatctcgtagtgcaccgcattcttcattgaagcaaaccagccgatcaccggtgcagcccaggcaccggcgaaattgcggataaagtgaagcgaaaccgagcgttttgaagcttggtgaatatctccggcaagcgccgtgcccagcgctcccgataccaataccatgctgacgccgctgcccagcaaaacagcatgaagatataacgactccatcgaaacaccgggttgaaccgatctccattccataccgacgatgatcatttccaaagcgccgatacagccgagcaatccggcgccaaaatgatcatacaaaagcgtgctgagcacggcagtagctaaaatccctgcgaaaaaacacaaataaaagcgtgtcatgctttcaaaagaagcctctgcaatgttttccaaaaatccgtttatcacggcaagggaaacaatgagtgcaatgtgtgaagcaacggccatgactgtcccggaaacagcttttgcggaccacagtgaacgaaacggcacaagaggttcccgggcgcgcaagtctgtaatgacaaacaacgccaaaatgatgaatccggccaaaaagaacggccacacataaaaagaatgaacacccgtcttctgcaaattgataagcggcaccgtcaaaacaaccatgagcaatgagagcataaaaacgcccgtcttatcaatcgaatgatgctcccgctcttccgctgcttgtttcggcaaagagaagaagccgatcacaaggcaaaggacaggcgaacaaatatttaatataaacacccagcgccatgcatccgcgctgagtgacagggaaccaaaaaccgctccgatggcagaagcgccgaacaatccgctaatgacgaaaaacaaaaacaaattgcggaccttgttcggaaacgaaatcaatttgacaggaagaatcgtcaaaaataacattccggagcataatccttgtatcacccttccgataagaagcgaaaacaagcctgctgaaaatgcgtcgatcagcgagccgcataaaaataaggtgatgagtgtcaggtagctgttccgaatgccgaacctccttgaaaatatacgtccaagcggaacaccgagagcaaaagcaagatttgtcaaaatggacggaatccgcatatcgtccggtgacaaatgaagtccgttttgaatgacgacttgactgagcgtataggaaagattaagaaaatattgcggcccaatggccagtatcgttaaaaccgaaatgatcaaatacttcggaatgccgatttttttagagctcgggatcgccatatcagattgactcataagcgctcctcctttagttatatatttcatattacaagttgtattatgcaagttaaattatacatccttcccgcaataaatcaaccgaaagaaaaagaaaaggctgatgatcgtctgaccaacagcctttagccgcttatttgctccactttttaaaatcctgattcagtctgatcaaatgggtttccaacgtgttcagttcttctgttgtccagtcttgaagaacctcagtgtatacatgatagcgggccttttgcacttttttcagagcatcaatgccctccgaagtcatctccacaaggctgatccggccgttgttgggatcaggaaaacgtctgatgagctttttccgttccaaggctgaaacttgtctgcttgctgtcgacagattcagcattaaggtttcagccagcgagttgatggcgagaggactttgcttatcaagctcgcttaacagcagatattccgagcggtccagacttccaaagcgcgggctgtaggccgtcgtcagacggaccaaaagcgcgatttctttctctatgtttcggagtgagtcatgacccaacggatattccctcctctttgtgtggttattcagctttcgttttaagtgcgatttcccgttgtcttagttcaaagcgcttgattttcgccgaaggcgttttcggcagttcttcgatgaattctatctcccgggggtatttataaggggccgtcatggcttttacatggtcttgtaattcctttgtcaggtgttcatttccgcgggatgggtcctttaagacaacgtatgctttcacgatcgatcccctgatttcatcagggcttgccacaacagcacattctttgacctcaggatgcttgatcagcgcatcttcaacttcaaacgggccgattgtatatcctgagctgatgatcacatcgtcattgcggctttcaaaccaaaaatagccgtcttcatcctttcgcgccttatcccctgttataaagtaatcccctcttctttgtcggagcgttcgttcttgatctttgtaatattctttaaaaagagccggcgtgcttaagtgaacggcaatatcgcctgtttcgcccgggggacagctctttccattcccgtcaataatatcaaccaagtttccaggcgtcggttttcccatgcttccaggcttgattttcataccttttaaaatccccaccaacagcgtgctctccgtttgtccgtatccgtcccgcacagcaatatgaaaatgctttttaaatgtatcgatgacttccctgttcaacggctctccggccgaaacagcgctgtgcagagaagacaggtcaaatcgggacaaatcattgactttcgccatgaaccggtactctgtcggcgtacagcacagcacattgacttgatggcgctcaatcagccgcaaatacgtttccggcgtgaattttccatgatagataaagccggttgcaccgctaccgagcactgctaaaaacgggctccatacccatttttgccagcccggccctgctgtcgcccagacgagatccccttccgaaatgtcaagccatgcggaagctgtcgttcttaagtgagcataagcccagccgtgtgtatgtacaaccccttttggctgaccggtcgtgccggatgtgtaagataaaaatgcgatgtcatcgcgagaggtatccgccgcttgaaaatccgctgcaatggcctgattcattttttcgagcagattgatccacccttcgctgctttctccgacggcaaataacgacagtgcctcttttgaacgaacatctagaaaagcatcaagaaatgctgaatatacgacggctcctttgacgcctgcatgcttgatcctgtaatccaagtctttcgcccgaagcatttcggaacatgggatgaccaccattccagcttttaaaatggccatgtacacggcatacgtttccggtatccgcggcatcatcacgataagcttgtcaccttttttcagtccagaacgggtcaatatgctgccgattttgtaagccttttcaatcaatttttcataggaccatgacacttgacgccctgattcatcttcccagatcaatgcggtcttatcgcgggaagatttaaatttttcaatttcatcaaccgcattatacttctccggcgcaatcaaatcttctcttctcaacccttccatctccttgtcttgtgccatctttttattatacataatcctttcatacaattgtattccgaaatgcctattttgcagaacataaaaaagagtggggattaaaccccacccattatccattgctttttaattttaattattgttgtgttccacccatttgctgttgagcgaaagaaactaaacgcttagtgatttctcctccaactgaaccgtttgcacgagaagtagtttctgctccaaggttaacgccaaattcagaagcgatttcgaatttcatttggtcgatagcttgagcagcaccaggaaccaatagttggttagaactgctttgtctgttgttttgagccatgtgttctcacctccttgtgagtatagattgtgtaaaaacacatgacttcatacaaagaatgtttggtaattgtatgcaaaaacagacaaagatgtttgattgaatattcctttagaaaaaatccgcaaattgatctttcgtttccgctttgctgctcaaaacaatcgtttccgtgttttccacagcttcgttgataagcggttcgaaatctgtgtagctttcaaagtgttcgattttctcttttttcggacgcgttttcggcgcagaaggcgtaaagatcgtgcagcagtcttcgtacggacgtatgctgatatcgtacgtatcgatttccttcgctttttcgatgatttccgtcttatccatgccgattaaagggcgcaaaaccggcgtgctcgtgaccgcgttgatggcatacatgctttcaagcgtctggcttgccacctggccgaggctttcccctgtaaagatcgcaagcgcgttatggcgttcgcgcagtttgtcggcgatctggagcatcagccttctggtcgccgtcatggaatagttctcgggaatctgcttttgaatgagctcttgagtttttgtaaacggaacgatatgaagcttgatgtctccgccaaaagccgtaagccgcttagtaagatcgatcactttttgcttggcccgctcgcttgtatatggcgggctgaaaaagtgaacggcttcgatctcaagtccgcgcttcatggcatagaacccggcaacagggctgtcgattccgccggatatcataagcatcgcttttcctccgcttccgaccggcagtccgcccgcacctttttcatcccggaatgtcaaatacgtggcatcttcccgaatttcgatacgcaaatggatgtccggggagtggacgtcaacggtaagatcgtcggtgttgcgcaaaatgtgtcctccgatctcggcattcatctcatttgtatttaattcaaactgcttataagcccttttcgtcgatactttaaaggtatccccgggcttgtattgttcttgaacagaagcgagcgccgtctctttaatgctttccagatctgtccggcacttcacggcaagactgaacgattggatgccgaaaacgtgtttcagacgagccattacagcttcagcgtcttctccgtttaatacgagagtcattctgtcgcgtgttgattcataacggacgttgcggaaatcgcgcaagaccattttgatatttcttttcaggcgatcgacaaaaagctttctattctttccttttgttgaaatttcgccaaatctgattaaaatgtagtcctcattcattgtgcctctacctcataattccttttagtttgtgtaaactttcttttaaggccgtcataaacgggccgacaatctcatgattatcccggtacgtcatgctgattctgatgctgcttgaggccgcaccttcaccttttcccatttctaaaagcaccttgctcggcttatgctgttttgaagagcatgctgatgtcgtcgatacgaaaatatcccgctcctctagcatatgcaaaaggacctcagccttcaatcccggaacggaaaaattgatgatatgcggcgcgctgttttcttccggcgtatttaatataacacctttcagctcttttagctccttgataaaagctgattttgccgcctttatttcttctatataatggttataatcctgttttgacaaattgatcgcttttgcaagtgtaacggcgccggcggtattttcagttccagcacgcctgttgttctgctgttctcctccggaaatcaaaggaaaaagcgagatccgttcgtttagaatgagggctcctgttccctttaagccgtgaaatttgtgacccgagattgtacaaaggtcaatggctgccccggagatgtccagcggaaccttgttgatgccctgaacatgatcaacgtgaaagtatgcccttgtgttttcttttacgattttcccgatttcttccagaggctggatgacgcctgtttcattgttgacgtgcatgatgcttacaagaatcgtgtctttgcggagcgcttgtttcaagtcttcaagagaaacaaagccatggccgtcgacaggaagatatgtaacctcaaagccgaaggccgtcttcagctgctccaaggattccgtcacagacgggtgttcaatggaggaagcaatgatatgctttcctttttgcgcatgtgccaaagcaatgcctttaagcgccatgttattggcttctgaagcgccggacgtaaacacgatatcatgattttttagcgaaagcgccgatttaatctgtttccgcgcttcagaaagcaattgatccgcttcaacgccgtggcggtgcagagacgacgggttgccgaagaagcgctgatttacttgttcataaatttgtaataattcaggatatggttttgttgttgaactattatcaagataaatcatgatctactcctttaaaatgaacgttctttttcatgactgtatatgttatcatatcaacttgtaattgaaaattaaaaataaatgtttgacttctctgatttttaaaatataatagtctttggacttttgtcatattatatcacgaaaataaattgacagaaaatttaaacaaaatgccaggaggttctttttaatgaaaacttcactatccgctaaggaaacgacggcgattgggcttatgctgttcgccctctttttcggagcgggaaatatgatttttcctccccagcttggtcaagctgccggagagaatatttggccggctatcatcggattcttgctgacgggcgttggtcttcctctgctcggcgtcatcgcggttgctttaaaagggagtgcaaaaggcctagctgacaaagcccacccggtcttcggcacgatattaatcgtcagcatttatttaacgatcggacctttatttgccattccgaggacgggaaacgtttcatacgtcatagcggttgagccgtttttaggaaaacattcgtcaagtctttatctgttcatctttaccctgatctttttcgggatcacttatttcttggcgttaaacccaagcaagcttgttgaccgcatcggtaaaattttaacaccgatattattgactgtaatcgcaatcttagtcatcaaagcgtttatcaccccgatgggcagcatcgggtctgtgacagaggcttaccaatccgcaccgctgtttgtcggatttttagaagggtataaaacgatggatgcgatcgcttcaattgtttttggaattgtcgtcattacggcaattaaagaccgcggagtcacaaatccaaagtcaatcgccgcttcatgcatcaaagcggggatagtcgctgcagtcggtctcggactcgtttacgtttcactcgcttatttaggggcgacaagcgttgaaaccgtcggttcgctcgacaacggcggcgaaatattgtccaaagcttccgcatatttgttcggctcgcttggaaatgccgtgctcggcatcgcgatcttgttcgcctgcctgacgacaagcgtaggacttgtttcttcttgcggagagtatttttcaaatctgattccgaagctctcttacaaagcagttgtcatcattgtgacgcttttcagccttgtgattgccaatttcggactgacagaaatcatctcgttttcagtaccgattctgtctgcgatttatccgcttgcgatcgtcgtcgttttgctctcattcattgataagctgtttaatgaacggcgcgaggtctatatcggcgcccttatcccgacaggaattctgagcatcatcgacggattaaacgcggcgaaaatcccgctggggccggttaacgatatcttaaaagcgaacatcccgctgttcagcatgggtgtcggctgggtcgttccggctgttatcggcgcagtgatcggttacattgtgacattttttatcgctttgccggaggacaaattaaagaacgtcagctgacctttgcaaaaaacagctctgtttaaaacagggctgtttttttatctttcatttctttagacaaaaaacccggcacacatcttctcgtatagatcgcaggctttttttatgcttttgcagctttactttgaaccgccggcttttgattcgatgcatggctgttcaacaccattccgataatcacaagagccattccgctccatgagatggcaccgggaagcggactcgataggattaaaatttcaccagcggccgcaaacagcacttcaaacgattgtgtggcctcaacagccgctaatttgcgcatatccccttttacaagatctgttgcggcaaagaacagcacagtcgcgcatattccggaaaatacagccaccaatcctgactgaatgacttgtccccggctgggcgcacctaccgatgccagcccgtacagcgagaggatcagccaaaacggaaggcttgccagcgtcatccccaatacccgctgataagcatcgaggcgcccggcgcaaacttccatcatttttctgttcccaagcggataagcaaatgaagccaatataaccggcgcgatgcacagcagcatctcgtgcaaagaaagctgtgccgcgtgctcagcttgcatcagcgccaccccgattaaaatgatgaacgacatcgtgagccccttataaggaattttgcctcttatctgtacgggacctgtttttgtttgaacggtttcataaaaaagcggcgccaagagggaaccggaaatgatcgtgatttgccatgttcccgcgatcagccagcccggtccgtaagccgccgcaaaacagagcggcgcataaaagagaccgaagccgatgatgctccatctcacccaaatgcccggcgcttttttaatttcctgaaaaagctctttcacattccccctaagccaaacgatggcaaataaaagaggcgccatgaagataaatctcagcgaagcgctccagatccagcttcccccttcaagctccatcgccctgtttaaaacgaatgtaaaagcaaaaaagaaggctgcaaaaacgcccagtataatcggcctcacaatcccttcactccttttcctgatgtccggccaatcgatctccgagactgagccagttttcctcggcaagcctgatggccgcatcccgatccccccgtctgcaggcatcgatgatgctctggtgctgttcaacagatttcaagctgccgatcgaggaaaactgcgacatttcaaggcggtaaatttttgaagaaatcctttccaatgcccgggttatttccgggttttttgatgcttgtaaaaacacgtcatgaaaagcagcatctgattcgattgcttcgataatgtcttctttttgaatcgcttgctgcaacgttttgttatgcgcctccagctgatcaaagtcggaatccgttaaaaaaggaagcgacagtctgacagccagcgcatgcagcgccgcagtgactgtaaaagcgtgttcagcctcctcgcgatttaacggtgctacacgtgttgccgatcccgggacagcttcaacaaggccttcatcttccagtcgtttgagcgcctccctgacaggtgtgcggctgatgccaaactgctctgcaagctcctggtcatgcaggcgctcctccggctttagctccaaatgtacgatggcgcgcttcagcgtttgatacacttcttcccgaagcgaaattcgtttgattcgtttaatgttatttttcatcataaactaatatatcggattttggttttatgcacaaccaaattttttatctaacccctttctctttagcggcgtattttcttttcgcctggcaatcgttgcagatgccgtacagttccaatcggtgatgtgtcactttaaatccggtcagccgtgccgcaatgtcttttactttctccagttgcggacaatgaaaatcgacgatcttcccgcatacttcgcatatgacatgatcatgttcctctagagccaaatcaaaacgaagcggatcggtaaaccccatttcttttataaggccctcttgtttaaaatagcggatggtgttgtatatcgtcgctgtactgacggcaggatatatctccctcaatgattgttgaatttcagctattgtggggtggttcctgttgtctagaaaataatggtagatagccagccgctgcggtgtcattcgaatgcctttccgtttaagctgcgccattgcttcctgctttacattcgtttcgttttccatacctctttcgttactgccccttttttcccttgaatcttccgatattctttgccggtggctttagaaccggagtgctttagatgtgatgttcatttaataaacgttctctttgatccgatcgagcgcctgccaaggcatcagggcacagttatgacgggcccgcaacggatggacgccaatcagggaaacggcatctcccagcagatcctcttccggctcttctccttttctgatcatattttccatcgcttcacgcattaacccggcttcttttaacgtctttccttttatcagttcagtcatgattgatgaggaagccatgctgatgctgcacccatctccgataaaagctgcgtcttcgatcttttcatttttaatgtcgataaacaaagtcatcacatcaccgcatgttggatttttgtaatggacgtaatacacgccgtgtttatcgatttttcgaaaatttcgcctgtatcttgcatgatccataatgacggaccgatacagctcttccagtgtcggcataaaatcatgctcctttccttttaaacagtatattttgattgaaagaataaacggattcagttatacttccgctattaaatcataataattacgatttaataataaccgatcaaaaatctcatcgcaaatgaaaagacacaatgaagctgccttttcaaaggcagctcggtcaaacacaagggggaaggatttatcatgaaggagccataccgcatgcagctcgagtcttttcaaatgacaattttatctgatggagcatttcgggtttcaagggatttttttttggcgggaggagactccaaggaaacagaacgttatcctgaagaatttgaagcagcgctgaactttgcctgtctggagacgaacggcaaacggatactgattgatacgggatttggggaaacaggcggacaagaaagcgggcacttgcttcatcacctgaagcaggcgggaatcaagcctgactcgatagactatgtcattttgtcacacagtcatttagatcacacgggaggtcttctaaaaaacggagagcccgcttttccaaacgctgttcatctgctcagtgaagcagaatggctgtacgcaaaacaaacgccggcgtctcctcagtttcacattctctccgctgtccggccgcttctgaagctgctgacagaagacaccgaactgcttcccggactgaagctgatccatacgcccggacatacgcctggacacctgaccattgaattgcatacaaaagacggcgtctgtcagatcatcaatgatgtatttcatattccggaaagtatctccaatccgaagctgcgggtttcgcttgagcatgatcctatcgagggagaaaagacaaggagactgctggcccgacaggcttataacggacagttcctgctccacggctgtcatttcccatatcccggcttcgggctgatcgaaaagcatggctcattttttcaatggaaaccggttctatacgaaaagaaaactcgctgatcagcgagttttccaatttaaactaagatatcaacgacaaactgtgaccaagattcaagtctgtcatagacgcttttttctttcagatcactggctttcatccaacggccggcaatctgctccttttctttgacttcaacgtgtgcgcccggttttaattcaagcgctgaaaggattccgatatgtactttcccgacgctgttttcatcatcattaatcagtccgagcgtcaccattttttctttagctgattcctcgattagaagctcttcatcaagttcgcggtctgtattcaacttcagaatatcgggaaagtcaagcccttcggcaaagttcatgtgtccgccgaagccgagtgacagcttgttgtgaagccgcgcttcccctccgccttcgagccgctcatatacaaatatttcgtcttctcttttgatgacaacataagggatcggctgtttaaatgcaggatcttcctcggcgtctccccttctcatttcactgaagtggcgttcaatatgcgccatgatcttcccgatcgtctcaccgtcgctgttgacgccttggaaggtcagcgtttcatttgcaaatacgttttcccgcgggaccacgagaatcatttcgtccatttttcccatcgtatccgtttcctcctcaaagtgaaaagagcagattcgttctgctctcattttgccgtgtatcaatagctgaagggcagggcttgggcgctggcgcgcccttttagcccggcttacttatcgtcaaagtaaaagtcgtcgtcttttaacggttcaactgttgcttttttgtagccgttccctttcattgagaagaagtcgtgtgacttcgttttcgtattcaacccgttcaacacgatcggattgatctcttcttcttcaaaataagcttcaaagccaaggttcatcagcgctttgttggcattgtagcggatgaacttcttcacgtcgtgtgaaaggccgacttgatcgtacaggtcttctgtatattcaagctcattttcataaagctctttcaatagatcaatggaaaatgcatacagctcttcttttttctccggcgtctgctgattgtaaatctcctgagcgagcaggccgacatagacgccgtgaatcgcttcatcacgcaagatcaggttgatgatttcgccgctttgcatcagcttgccctgtccgtaaaaataaagcgggtagtagaagccgctgtagaacaggaagctttctaaataaacggatgcgaccatcgctttaaacagcgagattttatcgccctggcggattttttcatagagcccgacaatgatctgagcttttttctgcaggtatttgttttgtttgacccattcaaagacttcgttgatcgtctctgtcggggccagcgtcatgaaaatgtttgaataggacttggcgtggaccgcgttttccatcatcgccatgaaattcagcaccgctttgcgctgatgcccttccacatgctcagcaacaaggggcattcccgtgttcccctgctctgtatcgagaagcgtcagccccgcgagcaccttcatgtatgtgtcctgttcatttttacccaagtacttccatgtcagaagatctccattaagcgcaatctcttccggaagccaaaactgctttacattttggttgtaaaacatttgggtaaaatcatcttcatgctttgaccagtttgctgcatcgtaaattttcgtcactttcgcatactctcctttaatcaaacgacacaagaaaggcagccttcttgccctgtatccttcgttcttgcatagtaaagtgttttgattcctttatggtgggcataaagatcgatccggttcaaatcgcgtgtcgtcattgtatctttcaggaacaatgtaaagcttatgccttggtcaacgtgctgctgaatcgtcgagatcatgtcgacaaccctgaacatgtccatatcatacgcttccttatagtagaaccagttgctcggcgcaagtccaggcattggataatacgtcttggagttgccgtatgttctttcttcaatccgctccatgatcggcataaccgatgctgtgcttgactgtacatatgaaatggatccggtcggtgcgatgcacagccggtagctgtggtacaatccgtgttctttgacaaactgtttcagctgctcccagtcttcttttgtcggaatgtgcatgccttcaaaaagcttggccactttttcgaatttaggcgagaaatcttgtgtcacatacttttcgaagtattcacccgttgcgtaagccgaaccttcgtagttatggtacgtctcacctttttctttggcgatctcggcagaccgttcaatcgagtaaaagttcatcatcataaagaaagtgttcgcgaagtccctcgcttcctcactttcgtaggcgatattgttctgtgccaggaatccgtgcaggttcatcgctccaaggccgatggatttcatcgctttgttcgcttttttgaccgccggtgcgttcgtaatgtttgtcgtttcagaaacgtgcgtcagcgagtcggttgcaagcttaaccgtctgctcaagcgatttgtttttcatgacgttcaaaatgttcaatgaaccaaggttgcaggagatgtcaaggccgatctcatcttcttgaccgtagtctgtgtatgaagaaacttgtgaagcctgaagaacctccgagcaaaggttggaaaatttaaccttggaaatatgattgttcgcatgcgcgttgttgacattgtcttggaacataatgtacggatacccggattccgatcttaacatcgcaagcttttcgagcatcttgcgcgggtggattttttcttttttgacgcgcggatcttccacaagccggtcgtacatctcgttcatgtccatttcatcgaggtgctcgccgtacgctttataaacggtgtgcggatagaagacgtatgccgctttatcctctcttgcaagctcgatgaatttatctggaatgacaaccccgatggacaatgttttcacccggacatcctcatcagccgaaatcttcttcgtatcgaggaaatcgttgatgtcgcggtggaaaatgtttaagtacgcagcgcctgagccttgtctttgtcccatctgatcagcgtagcggaatgcgttgtcaagaagcttcatcacgccgacgacgccttttgtcgcgttttcgacgtctttgatcgcttcgcctttcgcacgcagttttgaaaggtttaacgatacgcctccgccgagctttgacagctgcattgaaatatcaatcgctctcgagatgtcgttcaaggaatcattgacttccaggaggaagcagctgaccagctctccgcggcgtttgcggccggcatttaagaatgtcggcgtgctcggctgatactcctggttgatcatcattctgacgaattccttcgccttctccttatccccgtttgcaaaaaataaagctacgatagaaattctgtcttcatagcgttcaagaatttttttcttgtcgtttgtcttcagcgcatagtcattgtaaaacttaaaagcgctcataaaggacgggaatctgaattttttagcgtaagcctctttgaacacttccttgatttcttcgaacgtgtagcggcttaaaaactcttcttcatagtagtcattcttgattaagtaatcgattttctctttcagatcatggaaaaataccgtattttggttgatatagtctacaaaataactatgtacagcttctttatctttatcaaactggaatttcccgtctttttggatcatgatctcattgtttaactggatccattttggcacttgattttgtgacaactctttctacctcctgagtaaacagttcaacgtctttggccgtcccgctgagttcaaatttgccgagaatcggaacctgatactgcttcgagattttttctgcgcttttcgcaaaattgtctccccacactctgtttccgcttgccgcaactcccaaaagaagatgggcgtttttctcaagaaacatctcagtcgttttcggaacttccccaaaccctgtcgtgtacgtgatcaaaacaaacggttcgtctagatactcctctgtgctgactttccgtttattgcgaaaaggcgtcttatccacaaagcgctgaacgtttcccgtttttgaatcaaatacgatctgaatcatcattatcacgacctagtaaaattgtttccgagtctttcaactcgaaccttacacaatatatagtatactatcattcaagaaaacacaatatattgtgctcaggttgatgaaagttcacaatttgcttcagcttaggaggcctaaggccaaagaaatatgagtagaatgagagccgttcgctcatcctactcacaaaccgaaatctatcataacacgaaaaaaattgagttagtagactagactttttcgcttattttttgtaagtgtcacagcacttgttctcgcatacctctttaatatcggcttcgatgccgagttccttaagaaccgactgaacagccgtcatgatcgacgcttccctgacaagttcttttccgttgacgagaatacttgtgccgtattcatagcaggaatcatcttcacacgtctcttcccaatggttgatgacgatcttaggtttcattgttcgctcattccttttcattttcaaactgaattgatgtaaacactacttagtttagcgattagatgccgctttgtaaatttgaatgcctcggactttcacaggacgtgatgacggcggcgtcttagacaggttgccaaagtttttttcctctgaaagaccggcaacggccgcaggtgattgtaaagtcgccctgaaaacgaaaaatcccaaaacagtaacctgtttcaggattttgtcaggcaatctgaaaaaaccatgcaaggcatggtcttttagtccgtgaatcgctattccagttcgagctgaacgtttttttgcggtgcaaacgtagaaatggcgtgtttgtatatgagctgctgctttccttccgattcaatcaacactgtaaagttgtcaaatccttttacttgtccgcgcagctgaaatccattcagtaaaaagaccgtgacaaatgtattttctttccgaatctgattcaaaaactgatcttgaatatttatcgatttcatgtttctggtcctccttgtttctctataccatattgtttcgattaaagttcgagctttcctgctatgtaagtgaaaatttcctgttttttctgctcgatattgacagggggcgtcatgtcaaaccatgcgacatccatttgatttctaaaccatgtcagctgccttttggcgtagcgtctcgaattccgcttcaatgtctcaaccgcctcttccaaggacgctctgccttcgagatgcgcataaagctctttgtagccgatcgcctggacagactggcagtttcttacgttttcatcataaagcagtttcacttcatccagcagcccctcatccatcatctggtcaacgcggctgttgatcctgtcatagagcacttcccgctccatcgtcaaaccgatgagagccgtcgtgtataaaagctctttccgctgtccttccatatgttcggacatcgtttttcctgttgtatgcaggatttcaagcgccctgatgacccttcgtttattgtttggatgaatggctcttgccgcttcgggatcgcgttctttcaaaagatcatgaacatattcggcccccctcttcgcagagaacgcctccatctccgcccggaactcaggatcgcctgcttcctctgtgaatgaatagtcgtaaagaacagactggatatagagcccggttcccccgacaatcatcggaagcttccctcgcctgtcaatctctgcaattttttgtctgacgatctcctgatattcagctaccgagaaagattccgtcggttctttaatatcgatcagatgatgcggaaccccgttcatttcctcttctctgatttttgctgtgccgatatccattcttttgtaaatctgcattgagtctccgctgataatttccgcgttcaaacgctcggccagcatgacgcttaattttgttttaccgacagcggtcggtccgatcaaaacgatgaccggcggcttcgttttattcactgatgatcactctctttaaacaagctcctcccattataccatttcacattcaaaaacacccatttcattttacccgttttcactgttttccaaacattccctcaccagccaatcggctcatttccgacgatttctcttgtgtaacccttaaaaggatgccggtgcctttccttcattccatcgcttacataaacgactccgccatatctgaccgggggagccgcagaatatgccaaataggtcgtgccctcgatttcatgatagtgcgtgccgtccgcccgcggaatcgctggccccgtaatcgcataatacctatggtaatgaccatcgacgaaagaagtaattccggaataaaaatgaacgtgcccatctgtattgctcccgtttgccggctgggaaaaaccctcaattaggtggtaatgtccctcggcagtcgttgttctcgccctgtaggcgtgggcatggggaggcgcttttgaccaatccgactgatacagcgtcatgttttcgttcactcctttttgagggctgcttcactaaaaaatccggcgggcgcccaggcaaaaacggctgggcagaatacagtgatgttagtcaggtatcattttattattggagggatttttttatgtatcatttcgaccatgctcctgtatatgacgacgacagccagcgaatcattggcaggcctttctttggcggaccttttgggcggccgtttttcggcccgcgtccatttttcggtccgggccccttcttcggaggatttttgggcggccttactgccggagcgcttctcggcccttggggatatccgtatccgccgtatccttactatccttatttctgacagataaaggctctttcaggggcctttttacattacttttttcttgacttagaacttttgcatcaattaagatggattttaccaaccggttagtgaagcggggttttttttatgtctaaaaaaggggaaagctttgaagaagctcataacgatttcggaataaaagctgaaacactttaaaatcgtttatgggctgcgctttatgatattcgaatgaaaactaccgttcaactttgtacaagcgcgcgcagagggcgctgcggagtttgcccccccggcctttgcatatgtcaaactcgtatccggcgcatctggctttcgggaatgtttcaattggaactgctggctgacgaagagaaagctctccttttgaatcatgcaataaaatcgatagaggaggattccgtatgattgcaggctacatttttcttctgatcgccatcttgtcagaagcggcggcagccgccatgctgaaaatatctgacgggttcgcgcgctggcagccgtcggttcttgtagtaatcggctacggtctcgcattttacatgatgtcgctcacattgcaggtcattccattaagcctctcctatgcgacttggagcggagcgggcaccgttctgactgcaatcatcggcgtcttgtggtttcaagaaaagctgaaccggcgaaatatcgccggcattatctgtctcgtgtcaggcgttgtactgatcaatttgtcataaggaggcgaatgtcatgaaaggcatgatctttttggcggctgccattttgtccgaagtattcggaagcacgatgctgaagctgtcagaaggctttagcgcccccctgcccgcagccggcgtgataatcggttttgcggcttcttttacatttctgagcttttcattaaaaacactgcctttatcagcggcttatgcgacttgggccggcaccggaacggccttgacagctgcaatcgggcattttatatttcaggagccatttaatctcaaaactcttattgggcttactttgatcatcggcggcgtctttctgctcaattcaaagcgcaccgaagcagcggatcaaaaggctcagctcacgatcgaaatctaatccgctttggagacgacaatcttcggctctaattcaatggcgacgttgccctgaaccgcccttgatatcatgcatgatgtctccgcttttttagccagtctttcggcaagttcggcctctttttgcgccgcttctttcgggaggcggatcagaggtctgtgaatgattttttcgtacgtaaacaccccgcctgtcacatcgacaacggcctcggattccatcgtcaggctctctttttccaatccgcttctttccatcatcgctgcaagtgtaatgatatagcaagtcgcagcggcaccgagcagcatttcgtcagggtttgtccccgcccccgggccgtccatttcctttggtatcgaaatttcggtttttaaattcccgctttcaatccttccgatgtcgtttcgttttccaggccagtctgcctgaaggtaaaaatgatgtttagccataaaaaatacctcctttttttatcctgcttaaaagtctaccggtatttgacctttctgtcttattatttgcctgtcaaaccgtgacaactgtctaacacacagggcataagcggaacatagaatacaacgaaaatccgcacgagaaaggacgaaagaaatggagaatgcagaacatttacagcagacggcggttcccgaacagcatacgcatatcccccagtatcagcatcccgaaaccgccttgcaccacattaaatgtccgttgtttccccacttgaaacataagacgttgtgcacagtagcaccttttgttcattacggtttaaatgaagcccaagccacttcctatcaccatgccatggaagaagtagcggcaatggcttatttaatgggcatgggaatgaaccctcacttggcctactgtacagttgagtcatgggaaatataaacgaaacattttattaattggactgaacggtcaaaaatgaagagaaaagaccgttcagcttcaggaacgagttaaaacagacgccagcgtccggcgtgttcattagcgaaatcagccagtgaacgcggtttttttcccgtgatgcgttccactgtatccgtgatgcggttttctttgccgttcttgattttctcatctaattccgacatgaagccggcataatcgggagataatcctgcctttatataccttgttctcaacgcggacacttcgacattgacatgtctgatgtcgcggcctgccgctctgccgatgattgccgcggcttcggcataactcaaggcttccggcccggtcaaaatatggctcgtattatgcggcttttgatcaagcaatgcgcgcacagctacttcagcgatatcgtctgcatctataaacccgactttgccgtcgcctgatgcggtgacgatttcatttttctcccgaatcgaagcgccatgctgatggtcaaaattctgcatgaaatatgaaggctttagcaccgcccattcaggaacatatcgcctgaccgcgtgatgaagcttcccgaaaaccggtccatcttcatcaataattgcagcgctgagcaggacaatgcggcggacgccgaatgccgatgccatttccaaaaaaggcagtacgattggcgacggttcgtatacaccgacaggcgcaaccaaatacaatgagtccgtgttttttaatgcgtctttgtaagttgtttgatcattccagtcaaaatatacatgttctgctccggtaattgcaggtattctccggcttgcgatccggacgccggcacccaaatgcacgagccttttggcgattcggctccctgtcgtaccggttccgccggtaatcaatattttttttcccactttcatcactccttgtcagattataaaaaggtttgcagctgtcctccgaacgatttgacgacagtcaaaggattccaataatctttgtagtggacaattttgcccgctttaaggtttacaaggctgatgtactgttggttataaggaagacccgtctcacacacaatgccttcacattcaaattcgacagccgaatagcccgattttgccgtttgatgaatagtcggcgctgtaaagcggacaatatcgattttttcgggaaaatcctttatataatcgtaaatcgcggacttaccttctatttttttaggaaaacccggcggtgcgtatggatgctcaaacaccgcatcttgatcccaaagctgtatccacttttccatatccttttcaagcatcgactgcaaaaacagttccatcacatcggttatcgcacgcgtcattttctttcctccattcttttttgaccaatcagtctaaaatagtgataaaaacgggcagcagcccatctccccatgacaaacaatatatcaatcaagaatagacaggctgacatcgatcagatcctgaagggcatcaaaatcccccgttaacttcgcctgaaacgtgagcgacagccgggtttgattcaaaaaacgggcaactgctgaaagatcatggaggcccttctttagttccccctgtgactgtgctcggacaagcgctttgtaaaaggcggtttccaactgctttgtctgcttatcgaagtattcggcaacctccggatcgcggggaatttgttcaattgcgctgttgatgatatagcatgcctttgaacgttcggggtctttcagaacgtttaagctttcctggaagatctgccgaaccgattgcttcactgatccggggctttcaagcatggcgatcacttgcgcatttttatcatctagatatcttgtaagggcggcgataaacagatcccttttagtcccgaatgcattgtacagactttgcctggcaattcccaggcggctgagcagctcctgcatcgacgccccctcatagccgaattggccgaaaacctccatcgctttatgaaggacgagagcggtatcaaattctttgctccttcccaagcccctatcacctcctttatttgaaggatacactttctagactgttcagtcaagaattatccgcttcacggttctattcaccattccagctgtaaaaaacggcgcatgatccttctttaacggtcatagacatagcataaaaccccctgtcacatacagaggaacaaaaggaagtgtgccagttgtttatttatacagtccagccgggagattcactatttgtcatcggcgccaagttcggaatttcgattgaccagatccgattggcgaatgggttgatcgcaacaaacattgtccccggacaggctcttttaataccgctttatacatataccgttcagccgggagacagttattacacgattgcccgccggacgtttgtatccgtcgaagcattgcaaaaagcaaatccgtctgtaaccccttccaatatgagaccggggataaaagtgatgattccggaattgccgaaaaaaccgatcactgctttaggatattacacactgagaaacccccggttagaccaggaattgattcataattttgccccatacgccacgtatctggcattttttgaataccacatttcaagcgacggatcgttaagcgagctgaatgattcaccggccgtacaaacggcttggagacggcgcgttcctcccctcatgacagtcaccaatctaactgaatcaggcttcagtccgtctcttgcgcaccgcgtattaaatcagcctgccgtaagaaatcgcctcatcgacaatattgtccaaacgatttccagaaaaggatattcaggcgtcaatattgatttcgaacagattttggaggaagacagagatttattttcaggttttctccgcctgttgaaagagcggctgaagccgtccggctatgtgttgacgattgccgttccgccgaaaacaaatgaaaatatcgcctggctgaaagggtatgactatggcggaatcggcgcagtgagcgaccttatcttcatcatggcatacgactggcaccacgggacaagcgagcccggccccattgctccgatcaatgaagtccggcaaacaattcaatttgctctccgccatgtccccaaagaaaaaatcgttctcggctttccgctttacggctataactggaccctgccctatcagcccggtgccgtataccccggaatcgccaaccaagacgccgttcagctcgccatgaagcaccaggcaccgattcaatatgatacaaattctgagtccccttttttcagatacaccgatgaacagggcagacggcatgtcgtatggtttgaagacgcacgcagcatcggaaaaaaactgcagctgatcaccgaatacggacttgacggcggcggcgtctggcagctcacactcagttttccgcaaggaacatggctcttgaccaaattctttcgcgtccgaaaagtctgacatcattatgtgatttattgtaaaataacaaaccgaataatcccgctaacgaattttgatactaaagatgtgtccttcacacaataacaaatttgaaaggaatgtttgcgattgaataatgcgatccatgaaacattggagctgcatgagctgttaatgtttaaaaacctttgtctgacaaagtcatcaacaatgacgggaatggttcaggatcaagagcttcgcgacatcttggagcgtgatgcatcccaaacaaagcatcagatcgagcatttacaaggtctattgtcagtgagaggtgaaaccgtatgaacgaattcatccaaaacatgacaggcatgggcgcgatgactgaacaagtcattgccaccgattttttaatctcggcaaaaaccggtgtcaaaaacattgccacagctatcacggaaacatcttctccagaagtgcgcgaaacgcttaagcagtatttaaacgacgcgattgacacccatgaacagatcacaaactatatgatttccaaagggtattaccatcctgcgaatttatctgaacaaattcagattgataccaaagctgccgaaacggctaaagatcttccgcaactgtaataaaaacgtgtgaataccccgcagtccatacagcggggttttcatacttaaacggtttcttcttttttctcatcataatcaatgactgcctttggcagcgccgtatatttcgcccagtaaaataccgcaatcgatcctagcgcgatcaagattaaatcgaccggcgttctcaataggccaaggccgttaccgaatgagcccagaaacgataaaatcaggagcatcacataatatccgacgatccaccagcttgatttaagctgctgtgcaaacgaaacatcgtcctgcggaacgtattttttacacgcgcaataaacagcaaacatcacaagctgtgatccgagcagccatgacacggtgttccaccctgaccaatagacgatatacgacgcaaatatgaaggagacaggagcgatgacagccattcctttgatttgcagaggctttttaagctgcttggcattcacattcagcgccgctgctgaaaccggagcaatcgcataggagaggatcagggcaacagagcaaacattgacgagcgcgtcccaagacggaaacggaagcgtccaaaaaacggcgagcgcaaacgacagccacaacgacggacgcggaattcccgttggtttattcaccttggcaaagattttgaacaatgtgccgttccgcgcccatgcataaaccaagcgcgatgttgtattcataaaaatattgccgtttccgccgggtgataaaatcgcatccagaacgacaagagtggcaagccagcccatcccgagcagcaccgcgatatctttaaacggaagagaaaattccctgccgatcgctttccatccgtcatttagcatatcagtcggtatggctccgataaacaccacttgcagtatcgtatagacgcaagccgaaacaatgatgcaaatcagcagagcaaccgggatgttccgctgcggatttttcacttcgccggcgaccgaaacgatcggatgtagaccgaggtatgcgaacatcaccccgccggtcgaaatggatgtctgaaccccgccaaagccaaacggcgcaaattctcccgcaaagttcgccgatttaaaatggaatatcaacacgatgatgattgtcaaaggaacaaaatacttaaaaaccgaaataattaaatttgatttcgcaaacgctttgacactccaataattcagtaaaaagaacaaacaaagcagcgcaaactgcaaaagccagccgataatcgtcggcgattcagaaccttttatcgtcaaaccgggaaaccaataggctacgtattgcctgacagccgtcacttcgatcgaaatcaggcttgtataggcaacaatcgtgataaatgaaatcaaatatccgacaaggtggccgtgggtatacaccggatagcggataatcccgcccgtccgcggcaacgcagctcccagctcggcataaacgaggccgattaaaaggataatgacgccgccgataatccacgaaaagcttccagcgggcccggcttttgaagcgacattgctgacggcaaacagccaagccgatccgaatatcgcacccatgccgatcaaaatcaggtcaagcagagagatcgtttttttgaaattgccctgatttgacaaaacacttcctcctttttaatacatttaatagaaggtagtatgttcaaaaagcgccgctgtatacttttcccgcttccttacggcagcaacaaaaaacccggggattcccgggttcgtttaaatggttattttactcctgcgggtgctaaaaatgcctcaatttcatctgcggctttctcggcccctccggcttgtttaatgtgcttttgcatgtcctgtatccgtttcaggacatgcgggtcaccatccgtctgagagacggcttcccgcagtgaagctgctgttgtgtcttccggctgcaaatgcttgccaagcccaagctcttcgacgcggcgggcagtgatttcctgttcaggcatttgcggaacggcaacgagcggtacaccggcattcaacccttccatcgtactgttcatacccccatgggtgatgaacagctccgctttcttcaggatctccagctgaggaacgcgctgatgaatcgaaaagttctcaggtatgtcatcaaagctttcaggatcgattgtcgtgccaacagccatgataacctgccacttcgtgtccctgaatgcttctatgcacatatgataaaattccggccaggcattgaacgccgtccctaaagatatcagcatgacaggacggccgctgtccgaaataatcggcgtttctttttcctgaaacttgcgtttggcaagagaaggaccaacaaaagagaaccgctcatcaaacgtttcgccgtaaggctgaaaagcacgaggcataaagacaatgttcaattttgcaggctcgaacatatcctcaaagttaaatgacggaagattcgaatttttcaaagcatcctcttgctcaggcgtcagctcgatcttaaactcttcagaaatggatctgaatgtaaaatgttcgttctgtgcatatgtagaacaaaggcggaccgcctctattccaaacttctcagccagcagttttcccgccatggccataaagtcaaaaaggataaggtctggcttgtcattctcatagagcgcttcaagctgaggaagaacctcctccatttctttgataaacatcagcggagcctgcgacatatcttttttatttttcatcagctcccgaatttgctgcggatcgatatttaaagttgagcggtagttgagcggctctgccccagtttcctcaacagccttcacaaactcatccgtcaccggatatgttacccgataaccgcgtttgacaaggcttgccgttaaagctagcgttggattaatatggccgtgagccggaatattaaaaatcgcgatatgtttttgtcccatttcttaacctcccgttatttttgcttcatgacagcaccgaagatttaaaaatctctttcactatgttaaataacatattatagatcataaaggaaaaacccttcaaaattaaattaaaattaaaaaatactaatatagtccttttccttgcaaaaaaacacagaactttagcccttagtttaaggctgtgtacgactttattccccttttcgttactgccgacttatatttcaatcgttttataataaaaaacatccgtcaaaacagcactcgttttaacggatgtcatgaaattgccttattttaaatttagcttaaattattctgcaaatgatggaaaatacaaaaaaatttttataatgttattttggtcgcgcttcctgcttcatttcctttcaaaactatcgtttattgttttcttcttatcataattagatatgaaaggactgttgttattggtatatacagcggaacatcttgatgattatttaatggaacaagcatccaacaatcattttcacggcagcattttgctggcagattcaaacggtatactgttatcgaaaggatacggttatgccaattgtaaggacaaggtgaagaatgaaccgtctacacgctaccaaattgcctcactgacaaagcaattcacagctatagcggtcatgcagctgcaagaaaaggggctgcttcgtacagatgacccggtacaaaactatttagaaggctatccgaacggcgacagcattaccatcaaacatttattaagccatacgtccggaattcctgattttctagaggaagaattgctcgatattgagctggagcgcgcaccgttggaccaatttatcagacgttttattgacaagccgcttgaatttcggccgggacaaaggttcaattacagtaattcaggatacatactgcttacaaaaatcattgaaacgatcacaaatgaagcttatggagacgttattcaacaattgatctttgaccctttaggcatgaaaaactccggttttttctcttctccggaagatatttcgcctacagtcggatatttatgcctgaatcgtgaaatgatcaaagcgcctatcgtatacggctacggggaaagcgggctgtattcaaccgttgaagacttgtacttatgggacagggcgctttacaccgagaagcttgtctcaaaagatgctttgaaagaagccctttacagccgcgtcaaaaagcaggcttttgcagccgaaggcccttctccggcgctcattcaaaacaattcgatcggatacggatggtttattaatcatcaaaataagtataaaatatggcatgatggagaaatccacggttttatcagctcaattaaccgatacatggatgagaaaaaagtgctgattatgctcagcaattgcaacctctcaaaaactgacgagattttggcacacttagaagaagctttattgcaaatgtagaagctaaagacaaagaaaggcagcgggagcggtatgatcagaaaactattcactatcatcatcatggcaagtatcatcgcggtcggattcgtctgcaaagattcctggctcgacgtcatcagggacggaggcgtttattcggtattattcagcatgctgcttgtggcggcctgtgtatttttcccgatcgtcccgtttgcgctcattgccggattaaacggcgccttgttcggaatcgcaaacggcgtgctgatcacgctgacggggtctatgctcggcaccatgctcttgtttttcctctcacgttacggattcagagacatggctcgcagacacttaacgaaatacccgaaaatgagcgaatatgaagcgtattttaaccaaaatgcttttacagccgtactattgggcaggctgatcccggttatcccagccgttatcatgaatatcgtctgcggtttaagcaaggtgaaatgggctgtcttttttgcggcttcgacgcttggaaaagtccccaacgttctcgtcgtctctatcgcaggtgccaatttcagcgaaaacaagctgctctctgtcggcgtctacggcttatatatggcgatcatagcgtttgtcatctacagaaagtatccccatctgactcaaaaacataaagagacgaaacagacagggaagccttcttgactcgctgaggcggcaacgagagccgccgccttcgttttcgattgcaagctagccgattacaacagccgtaccatatccgatgagttcggaggttccctggcctgcagacagttcgaaccttagaccgacgatcgcgtttgctccaagctcttcagcttgattcacgagccgttccctcacagcttttttcgaatcctcaagcatttgggtgtaattttttaattctccgccaatgactgacttcaaccctgacagaatatcttttccgatattccgcgactgaacgatgctgcttgtgacaagccctttgacttcgacaatgttttgatttgcgattgtatctgttgtgacgatgatcatcaatatcctcccttttcctaaacttactagctaccataccacatttgccggaagcgtgcagttatttattcatcatatcggctggatttttaaaatgttaagtttttcatgcaacgtttcaccatattgcatagccgcatcgtttcaatcgcgagtttaggaagaagctgccgcttgccgcaagccaaactgcgccatatccattcagcaggcccaaattgaaatatccacagccaaagacgacttccctatgggctaaaagaatgccaagcaaagcaaacccgcggatgatatcaagtttaccaactctctcccccctgggaaatcgcaggcaacggtaatcaatgattcatcccgtacctgtccctctatcggaatagattcttatacataagtttcccttgtgctccgaaaaccggccagggaggatttctcattcatcttatttgcaagtcttgtacgacgttcatcagttctgttcggaaagatcattctgctcttgattaaaaaattgcactacttcatttgcgggtaggctgcgatcctaaaattttattcatcttatgatcaagatgatgtggtttttaaaaagctgatgaccttctgtgagacagatttaccctctgttcccagccaaatgagatgaccccagctgtctgcctgatagacttctgaaaaaggaatcagtttttttgcatgaaaagcatgctcggctggaacaacacgatcatatcggcaatgcataattaataccggacaagaaatctccttcaaatgatggaaagataaatcgtctatattttttaaatcaagcaagaaccctcgacttgaacgctgtctgttgttcatttttctcatttcttcaatatctccctccgtgactttcagcatcgcctgatcagcaggaagtgtagtaaaggaggatagcattttcttaaagatccattccggaaatcgattgttaagcgccgatatcagcttccatacggccttttcaacaggcggccgaaagatgatctgaccaactttatattcaatatccttcgctgtcagccactgctttgtgacagcgctttgcaaaattaaggattctactctttccgagtatttggatgcaaaacatattccgcttggcccgccggctgacaccgcaaccacatgaactttcttgatatttaaatgatcaagcagtttcatatagtaatagcaggcaagttccaaactgtccccgatttctttcgatgtccggccataccctgcacgggaaggcgtgatgatagagaatcggctctcataaagatctcgatacccaaattcctcgcggcaattcgaatgacctccgtgcatcacaagaatcggcttcccttcacctactcgcgaatattcaattgtcagtccgtcaatttcaaaggtgccgatgcttcttttcatcattttcatcctctcaagaagctttacatcaaatacgattttcttttcattatgtttcagaaaatcgagtcagcataaaaaacggctgggctttcccgcccaaccactcgaatatcctaagattttttgcgtttgcaagtcaataaatatagcaatccgccagccaatacaaaaactgtgaatatggcaaacgagcggctgaatacagcactccaggcatcgttcattgccggaagcgcagaatagccaaacccgtgcactgccatcaagcctcctgctaatgcgacgcctattccttcagataaaaaacaggcaaagttcagcatccccattccagcgcctgcagccttttcttccaagctttctgcggtactgtttgaaattgccgttttcacaaatgaaagaccgccaaatataaacacgagcataatcgtcatcaaccatggtgtccggtcgccgacctgtgacgcggctgccatggttgacaagatcaataaccatccaagagtaaaaacaaaccggctgccgaagcgatctgtaagggctccgcccgcaacgccgaaaaagataacgcccacagtgcccggaagtaagatgccgctcccgatagtatcggcatttaagctaaacaagactctcatcatataaggaacgacagagacgattcccgcaacgcttcccaatacagtacatcctgccaaaacgacgcctatatatcggcgattctttattaaagaacggtcaataaacggatgttctgcatgtcgggtatgaactgcagctccaatcaagcaaaaaatgcccgccagtaaataaaagacatgatacagcgatatatatacagcgaacatcacaatgctgattgtcagcagtccgatcccaatgatatccaggtttgcttttgcagcggcttcatcaggcatatttctaaagaagaaaggaatcgccatcagcactgccatcggcagaataaacagaaacgaccaatgaatataatgtacaatcattccgccgatggccggacctattccctcgcccattgccaccagtgatccgacaatgccgaatgctttgccccggccctccggacggacatagcgcgtgatgatgaccaggataagcgcgggtacagcggaagccccggatccttgaacaaagcgcgcaaagatcacagccgggaaataagcttgagccaacaaacccataaatgagcctcctccatagatgagcagtccggccacaaacagcttcctgacgccgtacatatcagaaagcctgctgtaaacaactgaaccggcagcaaaggaaatgatgaaactcgtattcacccaatttgccgccgcaggcgacacgccgaattgattttttatgtccggcaatgcaacattaaatacggtttcgttcatcacgctgaagaaagcgacaaagctaagccaccaaaatgccttcttttgatgtttaaaggtttgtattttactgtttttcaattgaatgatacccccaaaattaaaggggaatcacgcagtttatagggttaatgatgcgctttcccctcgaatgttaacccacttatttttttgcacttcatcattcatgcgcctcctaatatttgatttttaaattataaatggatatgagcaattgatcaacaaaggtctaaatgtcacttatcatatagctgaacttccacatggcaaaaaaaggccaatgaagaataccggtgcagtacccttcattgacctttattcgtgacatactgagcaagcctgccttgtactgtgcttttccgacggcttaatcaaattctctgtttaaaaattttttcagttccttcttttgttttttcgatacgaggatatataaaatatcgcctggtttaattttcgtttctccatgcggcgtgaccaaatccccatttcggatgatcgcattgatcagggcatcttttggaaagctgatgtctttcagcatctgcctggtaatggctgcttggtcatcgacttcaaattcgataatttcggcgttcgccttgccgatggaaacaagctccagcgaatgcggcgcttctactttctgcggtccgttcaatttcaatttttctgcgaagaccgatatggttgacccttggatcaaagccgatgttaaaacgacgaagaatacgacattaaagatcaattggctgttttcaagccccatcgtcatcggaaatgttgcaagaacgatcgggactgccccttttaatccggcccatgataagaagattttttcgttaaaattaaagcccattttgatggtcgacagaaaaacggcaaccggccgggcgataaaaattaaaatcagggaaagcaagaagcccttgaaaataatatcgaaggataaaaattgggcaggaaaaaccaataatccgagaatgataaacatcaaaatctgcatcatccaggcaaagccttcattaaacctgaaaatggaatgtcggtaagtcaaatcttgatttccgatgacaagcgcggcaatgtagacggccagtaagccgctcgccccgatgacatctgtaagactgtaggtaagaagcgcaaaagcaagagcgaagatcggataaagtccgctcgaatccaagttgattttattgatggcaaagctggcgaaccgcccgagtaaatatccgagcaaaagtcccattcccatctgccagaaaaatgaaataacaagcatgaaataagatgaatggtcagccgtcagcagctggatgagcgataaagtcaaaaacatcgccatcggatcatttgtacccgactctgcttctagagtggagctcaatctgtctctaatattctggcctttcaatacggcgaaaatcgcggctgcgtctgtagagccgacaatcgctccgaataaaaagccctccatccaagaaacattaaaaatcagcttggcggcaaccgcaaccacgcaggtggtcagcaaaacgccaatcgtcgcgagcgacaatgaaggaacggcgaccgctttgaccgaagaccactttgtttgcaaaccgccttcaaaaaggatgacgacaagtgcgataattccaatcagctgggcaagctcgggattattaaaataaataattccgagaccatcgctccccatgatcatcccgacaatcaagaacaatacaagggcgggcactccgagcctagtcgaaaatttcgttgtcagtacaccgataatcagcaataaggccgctaataaaataaactgctccatattaatgtgttccaaccatttatcctcctcccaatcttaaccgatactggtgcttttccccgtcctattacccggacttgcaccttcataaaacatatgtaacaatcgatggttcacgaatgccggtgtatagaaccgtccttatctggtcatccctcactctttccgtgaaaccttgtgcctgcaaccgcaataataccgataatgataacgatcggaatccaaatcacaacaaacggatgctcaggttcagcaagtgcggcaatgacagcccccaggcaatagagcacaatcgtcaaagcgcgaagccatgcgtccttatggatgaccttttggttgttattactgaggaatcgttttgtcacatcttcgaaaaagtttgccagcgtccccgttaggacagtagtggaaatccctgcaatgccgagctttctggctgccgtagtctgaagccccatcgcaatgcttaacagcaagattaaaaggtgcggcgaactttcaaagaaagtcaggcaggcaaatagaagcaatacggctgcttccacagcaagtgcaatcgtgacgcctgtcggccagaacgatttttcctgttttccgacaatggctgctgatataatcacgccgatgataaatccgaacagtgcgatcagcgagtacacggcggtcgcatgaagagaattgccgattgataatcctaacagtacgatgttcccggtcatattagcggtaaatacgtgaccgatacttaagtacccaatcacatctacaatacctgctgtcaaacagagaagcaaaagcatgatgtttcgatcacgagcagcattcaatgtgattcaatcctttcttagctattctgcccggcagaatgttaagtcattccatccggtatgtcatgagcctttcctaagggaaaactcgttttgggggctttttttgttgtaagaaaaaggagggttcttaacgaaaaaatgcgggcaatccgatcattcacctcagcaaaacacttttttgcttgtcgagttacatctgcaattcaattgtatcataagcattaaaattttttataaatgaagttcttaaaaacttgtttttacgaatggaaacacttcttactgttgaggaagcaaaaacaaatttacatcccctcagaaggcggagtttattggaagatccgtctgtttaactcaataaaaacgaacaagccgctttttaacagcgactcttccccatcccttaaaatcggttctttctattaaaatacttgcaaagttcatgttatacgcgggaggcctgatttacttcatacgccgcccgtattcccgattcaatcgctccctgcatccacccatgagtgagggaagcgtgttccccggcgaaatacacccttccttcaggcatcggaatataaggatacaactctaattcctgccctggttcgaaagctgtaaatgctccggctgaaaaaggattttgcgtccagctgaaagaagcgcctgatacaaactcagaatacacgatatctccatatattttcgctaaatttttcagcgtatagcggatccgctcttcttcaggctgactgtcccatattagcgcttcatcagcccacgtatagctcgctaaaatgacagcatgcccgtgtcctcctatgctgctagggtagtatgaaaagcgaatcggcaaatcggtaatcgatctgccgccgcgctgtccgactctttcccaaaacctgctcttaaattcgattcctatttttgtcgccgcaatatagttaagctcccgaatcgctctccgcttttggtaggaaaaggattcaaacggctcaaatgccacaaatcgcaatgctgaaaaaggtattgttacgatcgcgaagtcacctgtcaccgctgaatgttctgccgactgctggtgaatgcaatgggctgttacactgtttttagtttgagacattttcatcaatttttgacggaataaaatattcccctttaattgcggaagaaaagcttgcgtcaacaggtccatgccgcctgtaatctcatagaagcgagtcggcgatgtaaaaaaaatcgattcccgcaatacttcgacaagggacaatcccatgtacgcttccatgtccaaaagcacaccaatcatatcgatggaaccgcttgaaaaatgagtgttgagaaaagatcctaacgattcgttcctgtattgtttttcaacaatacgccaatttctcgccggatcttggctgataaaattgaggataggctgcaaagcagaaagcatcagctgttctgccgtttttccctgctcatggggagcaacagggaaccttaaaacgcccggatttttttcaaactcatgaagacgggttttcacgccgttgacgtaaagaatatccatgggggttcggttgataaacacattgacaggcagattaaacttcttaatatattccatcgttaaagtatggatatcggggatgcgcatcggcccggcattgaaatacaacccttcgctaaagggcgcacgggaagtaaaaacacgccctcccgctctgtcatttgcttccacaatcgtcactctatgcccggcattctttaataaagacgctgcgataagtccggacaacccggcaccaacgatcatcatatgcttagggtactgtgccgtttgaagaccattcctgatgatacgaagcatgtctttttcagttaattgaaaattcaatttattcagcgcccttttcggtggatttattgcattatattccgtttaaaggacgccaatcaccattttcatcctctctgcacgaagtcctcatgatagtcggctcttcatctgagactcgcatgagggtgaagttggttcaactatttttaaaaatgtaaatcaatatcctataccaaatttataaagtgacataggataaactatgtctctttagggaggtgaaacatatgagcggaggttacggacacggaagcggttttgctttaattgttgttctgttcattctcttaatcatcatcggcgccagctggttcggcggtggatatggaggctactaaaaagttcgttttaaaagtcagcaataacttatgaccttctccttattttacatgttctcctcctgcttaccgttgttgactccatcatgaaaggctcttttttaaaaaagagcctttttttaatgcaatacagataccgaacctctcctgctgctgaatgttaatagaaaattaatgtttttttcaaaaagagacatgattttcattctattaatgctattatttttccatcctattaataaataggaaaattaagagagggagtgttgttatatgtttaaaactaagttcaagaaaacaattgggattggactcgttgccgctgcctgtttgatttccgcgtcgacggcaagcgctgcgtcgcaaaatgaaagcgatgttaaagtgaaactggacgatcagcagcggaatcaatatacggtcaaatctttccactacttaaccgttgacggaaaaaatgtggattcgccggctcaagccaacgccaaatccgtcagagatgtcaaagtaaccatggttctgcccaagcagaataagaacggcgatttgcttgcgtatggatttacgagcaaggttactttagaagcctttatcgcgaaagacaagcagaggcttgagaagcaattcaaaccttctgccagcggtccctgctgtaccgatttctatgaatataaaaataaaggcgggcagtatatttactggagagacggatttaaaaacttgccatccagctggaatgacagaatttcatcgttaagtacggcgtctccttcatcaagctattcaacgacgctgtgggagcatacttcaactcaaggatacggcaaaggcgttttgtttagacattccgattggtacggcaaaactgctaatatggcttctgattgggacaataaagcttcggccatcgatatcaagtaacgggaaattgaaacatttattcaaagatgaagtgtcaaaaaaatagagagcaaagcttaggcctgctctcttttaccctgtctgttgccaattccgcttagatccgtcaagcaaacaataacgaacgcgctttcaaaaacttgcggacaatttagtgaccaacttatcatatgatgctgcactcgaagtccttctacggaggaactcatgcataacataaacattcgaaaagctatttctgccgatttgccatttatcttaactatttataatcagggcattgaagatcgaattgcgactctggagcaagatttaaaggaaatgagcgatatcgaaatatggtttcaggaacatcaagggcgctattctgtccttgtggccgaatcaaaaggagaaattgtaggctgggcttctttgaacccgtactcccaccgttgtgcttatcaaggtgttgccgacctttctgtctatgttgatcgtgcatgccgcggaaaaggaataggcggcctccttcttcaagctctagaaaaaacagctaaagagaatagtttttataaaatcgtcctctttacatttccctttaacgaacttgggcaaaacctatacaataaaatgggctacaggcaagttggcatctttaaaaatcaaggaattttagatggacgttttatcgatgtaatggcaatggaaaaattgctatagataaaaaaccccttgattgctcaaggggtttttgcgccaaggtgcggctggataaagaagctgcacagatctcattggcaccgtttaacctcttctatttgcgtttgacttgaaaaagagataaaatgatttacaaatcgtaataattacgttttgttgtagtattgaaataaccaaaggcgcaaaagaaggctgaaatatatggagcttttcgaaaggagtgaaatactgcggatgttgccggggccgtctccccgttatgagtatcacctttcggacagtgatcgaccggggcgcctctatattcattctcagttctttatcattttatcgcttacaaatcggaataattctgttttatttggagggaagatacatatggcgacatgggatttaagtaatatgaaacatcatatttttatctgcaacggcagcagctgcaatcgggccggagctgaggaactgactcaagtgattctgcaagaaatctcggagcgggagtttgacgatgtcattcatacaacgcgcacgcggtgtaatggaagatgccaagataagtgcgtggccatccattacccgagaggaacttggtatagagatttaatacctgaggatgtccccctcctgattgactcgctttgtaccaatgaagattataaagaaaaagcaagccatttgtatgacggccaacgcttcgaacgttcatccggcgtcatctccggagttccaaaagaaaaagtaatcaaagtatcgaaaaaattttaaatggagtcgaatgatcatgcctataactaaaaagaaaattcctgtcgctattctcactgggtacttaggcgccgggaaaaccacacttttaaatcgaatacttacagaaaagcacaatcaaaagatcgcggttattgtcaatgagtacggagaagtcgggatagacaaccagcttgtcgttgattctgaagaagaaattttggaaatgaacaacggctgtatctgttgcacggtccgcggagatttgattcgcattctgagaacgcttgtattctcaatgtatcaagggaaagttgcatttgatcgcgttttaatcgaaacaacgggactggctcatcctgcccccgttgcccagacgtttttcatggatgaactgctatccgaaatatttgaagttgacagcatcgtcacggtagtagacagcaagcatgtcaccagacatctggatgatcaggatgaagcgcaagagcaaatcgcatttgctgacgtcatcatcctcaataaaacagatttagtatcgaataacgagctgaaatccttggagcaaagacttgtcaacattaatcctacggctaagaggctgcatgccagagattgcaaggtcaatttaagagatatactggggatcaatacgttcgacgtcaatcgaaaaattgaaatcgatcctcattttctagaagatcatcatcaccaccatcacgatgataaagtgtcttctatcgcttttcgggaagagaagcctcttgatttggcaaaggtggatcattggatgagttatctcgtacgggaaaaaggagaagatttattgcgttataaagggatcctttatattaaaggcgaagaatatcgaatcgtattccaagggcttcatatgctgttttcaggacgtccggaccggaagtggaacgaaaacgagaaaaaacaaagcgaacttgttttcatcggaaaggacttggacaaagaggaactggagcggcaatttaaaaattgcatcgcaaagtaactctttctcgctttgttggctctctctttgcttaacagaaagacccgagatttgattttgcgagtctatttcaagggcaaaatcagtttttaagcaggttatctcctgcttttctttttttataaggacttccctgtgtcccctgactatcgcgcgcaatcctgcatagactccagcctccagccgttcctcctgtgaagctgacgaccttcatcatcattcgatacatccgagttcacacttgataagggaaaggtgcgtctcccattctggccaataaaaaagcggccaccaatcagctgcacaacatccatatgcaaaaggtcagtgtccgcaggctctccttcttggactcgatattcacgttcgtttttcttgtctctatcgtatgacaaagtggaatagaaaaagtcccccattttatccccctttttgtcggatttgaatatgaaaaaaccttgataggcagttgccaatcaaggtgtttaaatagttctcttagttattctttttaatgttatcaagactacattttccaatatggatctcgtattgttgttcttcaaaaaatatttttgcaatcattcctgtagatttatcagcaattaggaaattatcaggttctgacatttcccaaagctcatgaattgctttagaatagtctaaaactcgaacatttgcccacactggttgtaaacatttgggaacaacgataaaccactcttttttttgtttaaggaaacttagggaattttctatccataaaatattgttttctttagaatccccaattaatttataataagttggtttggaatctattcttcgaaattgttttagtaatggctcgaacaagtctatccaaggagaatcaaactcttcaaaatctaatagttctaagcaagtaaattccttcatcgatttccttgcattcattatcgctttttttgtttaataatttcattacgagacgacataacttcctcaccttttatttatagtatatatggtggtctccattaggaccgtatatattagtatatctctctttcttaaagtcatagttgaattgatttgcctctttgtcaggcttacctgcatgtgcgtgtaatctgttatcgttagtatgggtaacaaccactcttaatccttcaggagtttcgtactcatagtaacgtccatgatgggttggatttgaactatatttatagtttttatagtctacacccttcttagttatatcatcgccaacctgccattgacgtgtaggttgttgccagctaagtcttttgcctgattgagagcttgttttctattaattttaggcgtagcattagcacttctctcggcattcgaaacccttttcgccgtcttcgcacctttagtggctttgaaagcatatttccctaccttgactactttagtagcgggtatgacagaaacaccggacaggatacggtcagtgacggttagtttttcaccagtcacagggtcaacacctgttatcgctctataaccatcataaccaccggacaattccccaactgtgtctttagcccaatcaagagctttttcaatgttgcttttcttcactctgctttccggtatgcgactgacaagttcgtatttcacttcaccgccggatatgtattttcggacaatttgaccgtttgaataaagcatgtacgaaccgccgatgaagtccttgcctgtaccgatttcatcggtgacatcgacagaaccgagctttttgtatcccttcatatcatgcagtgaatcaaatcattacagtacctcggacaaaaaaattttctaatcactgctatgaataatctgatgatttctaaatgaaaatgatgactgttggcagcgttggacaacaatcctccaacaattttccactcgattacgggggttgatttttcgtcattgaatgtttcgcgctttaatcattcacattgcttttgattaaccattctacttctgttaattgttgattttgaacatcttttgtgtgttttttcgtgaaatgggctttaacagcttcttcgttttcccaaatctcccagagcattattttgcgctccgacggttcaagcggataagcatggaattgaatacacccttcttctttgttcgttttttcctcaagtgttttgaattccttcattatttcattaaggtctttatcgctgatgatgtttaagcatgccgttatgtaatgcatcaaaattcccccctcttcaagtcatttcgtggcttttcattataacattttctagaaaaatgaaaacagctgcgaaatctgactaatggttgcctatgagacctgatctcaaagagaagccctcttttggttatccaaattttcttagaattatagcttacaatcatccataaaacagaatacccggacgatatacgtgccgcttcctaattgtcttcttacagacggcaagatttaaagcaggccgtctagtgttaatgcggtcaaaatgtggtcaataaaatcaaaatcgcccacagccattgatataccaaaggttgtgagcgattaaaaattacattacccgcttaaacatcttctccatctcataggtggagtagtggatgatgatcggccggccgtgcgggcatgtgaaagggtcggatgttctgcgcagctcatcgagcagggcggtgatttcgtcgtcccgcaggtgatgattggctttgatggagcctttgcagctcatcatgattgcggcttcttcgcgcagttttttgatgtcgatcgtgcggtcatcaaggacctgctgaatgatgtcttcaatgatcgtcgtttcttcccctttcggaaaccatgtcgggtggcatcggacgatatagctgccggcgccgaacgattcgagaaagacgccgactttggctaaatcgtccaagtgctggtcgatcgtcagcgcttcattttttgaataatggaatgtcagcggcacaagcaggtcctggacttccgattcgacttccccgactttttcacggaaatattcgtatttgatccgctcctgtgcggcgtgctgatcgatgatgtacagcccgttttcattttgggcaagtatgtaggtgccgtgcatttggccgatcggatacatgatcggcaccttttcttttggcgtctcttcgtcctggacgttctctcctgcctgttccggttctgcttgtacggccggcgcggcttcaggcgtatactcttcagctccgggccattcaggctcggtgtcctgcattacgttttcttcgcgctcttcgggagcggaaggcggcgggtctttgacaagcgagcttaatttcatcgccgaaaacgaaggctccggcttatactctctttcaacatcagaatcagaaagaggtgccggttctcgtacctggtcgaaatcaagcttttgctgctctggtttattgatcagaggtgcggtttttttcgggacctgcacgcttggaatgagctgctgctgtttaaagacgtctttgatggcgtcgcgaatcagctcgtgaagctccgtctctttgctcagcctgacctccagctttgacgggtgcacgttgacgtccacaaggagcgggtccatgttgatttcaatgaacgtgatcggatggcggccgatcggaagaagcgtatggtagccctcgtggatcgcttttacgagcgggaagtttttaatgtatctgccgttgacgacagatgacatgtaatttcgcgaggcgcgcgtaatttcaggaagagcgatatagcccttcacttcaaagtcaagagatctcgcttcaagcgggagcatttttttggcaaccgccgtgccgtaaatcgccgcaagcacgtggcggacatcgccgtttccgtttgtctgcagaagcgttttcccttgatgacgcagcctgatcgaaacttccggatgggcaagggcgattctgttgaccacatctgtgatgttgccaagctcggtatgaatcgttttcatgtatttcagccttgccggcgtattgaaaaacaggttggtaaccgtaatttcggttcctctgcggcttggcgctttttgctcggaaatgattcttcccccctgcagcgtcaaatgggtgcctgccccttctccggtgctcgttttaatgcttaagtgtgagacagacgcgatacttggcaaagcttctccgcgaaatccgagcgttctgacgcgaaacaggtcgttttcgtctttgattttgcttgtggcatgacgcaaaaaagccgttctgcagtcttctgcgtccatcccttcgccgtcgtcaagcactttaatcgaggcgagacccgcttcttcaacatcgatttcaatcacggagctgttcgcatcgattgcattttcgacaagctctttgacgaccgacgccggcctttccactacttcacccgccgcgattttattcgataaatcgtcaggcagctgaacaatttttgccaagttggctcacctctttgttactttaattttttttgcagcctgtacagttcattcatgacttgtataggcgtcatatcgagcagatccatcgctttaaattcggctaaaacagcctgctcttttttggagagcttcgtctctttttctattggcttgtccgtctcaaaaaatgacagctgggccggttgatctgcaacagtcgccgcggcttcttccgccgcctcttttaccatattcggtgccgttgatggagcggcttcttttgcgccggattcaagttctttcaggatcgttttcgccctgctgatcaaaccgtcgggcaattcagccagctgcgcgacatggataccgtagcttttatctgctgctccttcttttatctggtgaaggaaaacgacctttccttcgtattcttccgcacgaacgtggacattcttcaaatcgtccagcttttcttcaagggacgtcagctcgtggtagtgagtggaaaataaagtcttcgcgccgatgtgctcgtgaacgtactcgatgatcgcttgtgcaagcgccattccgtcgtaagtggacgtaccccggccgatttcgtcaaataaaatcaagctgtttttcgtcgcatggacgatcgcgtttttggcttcaagcatttccaccataaacgtgctctgtccggatataagatcatccgctgcgccaattctcgtaaagatctgatcaaagatcggcagcaccgcttttttcgcaggaacaaagcagccgatctgcgccaaaatggagatcagcgccatctgtctcatatacgtgcttttcccggacatattcggcccggtgattaaaagcatctgcctgcctttgcccatttcacagctgttcggaacgtaagactggctgtccatcaccttttctacgaccggatgccgtccgtcgatcacctgaacgacatcatcggaaaactccggcttaacatagtgccggttttcgctgatcgtcgcaaaacattggagcacatcaagctcgctcatcatttttgccagctgctgcaagcgcgggatatattccttcaccttgctgcgaagctcggaaaacagctcatactccagctcgcaaatattgttttccgcttcgagaatcagggcttctttttctttcagctccggcgtgatgtagcgttctgcattggtcagcgtctgcttccgttcatagcggccttcttcaagcagatggatgttcgctttcgtcacttcaatataatagccgaacaccttgttaaagccgacttttaaagagcggattcccgtgtactcgcgttcctgctgctcaagccttgcgatccagtcttttccgttcttgcttgcgtccctgtattcatccagtttcgcgtggtagccgtctttgattaagttcccctcttttaaagaaagaggcggattctcgtatatcgcgtcttccaaaagattcaaaagatcgccgcacggatcgattttctcggcgcgcgcttttgctttcggatggtcgagggagccgacaagctgtttgatggccgggacttgtttcagcgattccttcagctggatcaaatctctggcgttgacgttgccgtatgcgacccttccggcgagccgctcgaggtcgtatacttccttcagccgttcgcgcaaatcttcccgctcaaacagatgggcgatcagcgtttcaacgatttcctggcgctcttcgatctgtccctttctgatcagcggcctgtcgatccattgctttaacagccgccctcccatggccgttttcgtttcatccaaaagccaaagaagcgagccttttttgtttttcgaacggatcgtttccgtcagttcaagattgcgtttcgagtacaaatcgattttcatcgcttcttcgagctcgtaggcctgaacgttttgaaggtggtcgaggcttcttttctgcgtccgcttcaagtagacgtaaagcctcataaacgtatcgacaagctctttggaccccagtccgttcacaatgccaggcacttcatccgcttgttcatcctcgaaagagatcgtggcgccgcagcgctctttcagcattgcgacgtctttctcgtcaaggttgcggctgacgacgatttcccttgctccgacagagtaaatttcggaaacgacatcatcaagcctttcgatagccgttactaaattctcgcctgtcgtcaaatcagaaaaagcgagcccgtatgtatgctgaaatttactgacagaggcgataaagttgttttcattttcatgaatccctttgccgtccatcacggtgccgggtgtgatcagctgcacgacttcccttttgacgactcctttggccgatttagggtcctccacctgttcacagatcgcgactttatagccttttttaatgagctgttcgatatacgaagagcaggaatgataaggaaccccgcacatcgggattctttcgcttgatcctccgtccctgctcgtcagcgtgatttcgagctcctgagacgccttttttgcatcttcaaaaaacatctcataaaagtcgccaagacgaaaaaataaaaaggcatcctggtactctgccttaatctttaaatattgctgtatcataggcgtgtagcctgccatatttaatccctcactatgtataaacgtttctattgattccaacactcattataccataaagattcgtgctgaaaaaaaagaaactagggcggtgtttccctagcttccttttattcttctggatctccaaccaaaaactcgggattgatatcctcaagttcttcatcaagctcttcttcccacgcttcttcttcatcgctttccgtccaatcagaattgacctcaacgacgaccttcgtctcgccgacgacctctgctaaaaattctctttccgcctgtacaaccactttgtttccgttcggagaaatggtcacttcaaggcagttcggctgctgaagcactttcgcaatgacttcgtgttcatcatctaagtaatttttgtcgcgataccggagcttaatgacatcaacataggaaacgcgttctgtcacaacttcggttttggtgttgtccgcatatgaataccagacgttgatatcatatgtcccttcaatttccacggtttttccgattttttcagcgtcatacttatgattgataatccaaccgcctaaaatactggttggcttttgcgaaggggagattgtatgagtggactgggtgaatttccggcctttcgcgaccaccgctttagtgataatttccctgtattcagacattcggtcatgcctccttgtttttcctcgtattatcctatgctgggcattcgtctaatgtgcgttccttgagaaatcaaaataaattcccatataatgaatctgtttaagtgtatgcaggtaaaaggataaacttgacttaaatcagaaaagaaaaagacagccgaaaaacgaatcttttcaataagccgtcgcggcgggaaattgaattcaaaaaaaacggcgccttaaaaggcgccgccaaattatagagaacagctcggtgatgaatttttcacttttgaaccggtctcgcctttcagcaggtctcccccggtcgatgtgatgatctcgtttgtcacttggtttgatattgtatgcgcgacaagctgaagaaggtcgttgacttccatttgggagtctctgaactcttgaatgatcggaatctcgtcaagctcttcctgaagcgcgtcaatctttgcttccgtttgtttaagcgcttcgtgcttttcgtaatgtttaaagttgacggcttgcttttgcagggctttgatttggttgattatgcccgttattttggcattctcattaatctgtgcctccgcttttttgaaaaagtcgacttcttccgtttctgcaatcatttttgcgagctcccgcgcttttgcaacaatctcttttttcgtataaagcgtcactttacttcacctcgattgcttctcctaccatttccccgtcaagcgaccaagttttcgcctggtggattttcacgttgacaagctggccgatcgcttcttttggtcctttgaagttgacaagcttgtttttccgtgtatagccggcaaggatatcagggttgtttttactttcaccctctactaacacttcgacaacctgcccctcatattccttcattttcttcgcggaaatttcgttgaccacttcatttaaccgctgaagccgttcttttttcacgcgcatcggaacattgtctttcattttggcagcaggcgttccttcgcgaggcgagtagatgaacgtataggcgctgtcaaattcaacctctctgtataaagagagcgtttcttcaaattgctcgtctgtttcgttcgggaagccgacgataatgtccgttgttaaggatgcgttcggcatcgcttttttaattttggcgacaagctcaagatagcgctcccggtcgtatttgcgcgccatcagtttcaagacatccgagcttccggactggacaggcagatggatgtggtccagaaggtttccgccttttgcgagcacctcgatcagatggtcgtcaaaatcgcgcggatggcttgtcgtgaagcggattcgcggaatgtcgattttgcggagttcatccatcaagtggccgagtccgtattccatatcctcaaaatctttgccgtaggcgttgacgttctgtccgagaagcgtgatttctttgtagccttcagccgcaagccttctcacttcctggatgatgtcttcaggacgtctgcttcgttcttttcctcttgtgtacggcacgatgcagtacgtacagaacttgtcgcagccgtacatgatgttgacccagcctttaattttgccggtgcggactttcggaaggttttcaatgacatcgccttctttagaccacacttcgatgaccatttcttttgacagataagcctctgacaaaagttcgggcaagcggtggatattgtgtgtaccgaaaatcagatcgacgaacggatgtttctttaaaatccggttgacgactgattcttcctgggacatacatccgcagactccgaggatcaaatccggattgtcttttttcaaagcttttaaatggccgatttcgccaaacactttgttttccgcgttttcccggatcgcacacgtgttgagcaaaatgacgtttgcatcttccgtcgagtcggtcggttcatagccgagcgccatgaaaatccctgccatcacttcggtatcgtgctcattcatctggcagccgtacgtgcggatgtaaaacttccgtccttcgcccatgcctctgaactgctctgagattttaaaatcgttatggtatttaacctcttctttgccgcgttttttcgcatcttttaatgaaggcggaacataaacagcttcgaagtacttgctgtaatccttctcggattttttgtccgatggattgacctgtccgctttcaatgcgctgtttctcattcatgtttttgatctcctttcaaacaaagctccactcttcagtataaaggttctcggttgtcagcacaacccagaacccatcattgtacactaactgaaaatgattatcaatggttatttgctttgttcaaaaagaaatcgatgagtttaaagcagacccgcttttttagcgccggtttgaatgatttcaagcgctttatcgagctcttctttcgaatgctgggcggtcatgatcgttctgatccgcgctttgcctttcgggacggtcggaaatacaatggcctgggcaaataaaccgagctcaaaaagcgtgtttgagaagcggcatgcctcagcttcatcaccgatcaaaatcggcgtaatcggcgtttcgctcttaatcagcggaaggccgattttttcaagctcttttttgaagtacgcggtattgtcccaaagctttttaatcaatgaaggttcctccatcagcacattgaccgcttcaatgcatgccgcagtgacggccggcggatgggaagtactgaagagaaacggtcttcctttatgctttaagtagtcgatcagcaccttggatccggccgcatagcctcctaatacgccgatcgccttgctgagtgtgccgacttgaatgtgaaccttcccgtccagcccgaaatggtgaaccgttccgcgcccgttttcgccgagaacgccggacgcgtgcgcgtcgtcgaccatgacaaatgcgtcatactgttcagcgagccggacgatttcgggcagcggcgcgatgtctccgtccatcgaaaacacgccgtctgtaacgataaggcgcattctgtagttcatcgactttttcaaaatcttttctaaatcttccatgtccgcatgctgatatacttttttgcccgctttggtgagtctgatgccgtcaatgatggaagcatggtttaattcgtctgagataacaagatcatctttggtgagaatgcttgaaagaatgccttgatttgcggtaaatccggactggaatacgagtgccgcttcagtgtttttaaatgaagcaagcttcttttcgagctcatcatgcatggtgaatgttccggctattgtacggaccgatccggttccagctccgtaccgtttgaccgcctcttcggccgctttttggaggcgcggatgagacgtcagcccgagatagttattggatgaaagctgtataatgtcttttcctttcattttgacggttgatccttgcattgattcgatgatcggcagctcttgaaaagttccgttttctttcattgtattaagctcggaagctaaaaaattgaattctttcatattaatctctcctttctacggtatcagtacgactttgccgcattgcccttttctcatcagttcaaagcctttttcaaactcttccatcgggaaacggtgagtgatgacaggcttgatttgaatcgtgccggattggaggataccgctgacctgtctccacgtttcaaacattttgcggccggtaattccttggaccgtcaatcctttaaagacgatatcatttgtcatgtcgatgcatacgggatgctcaggcaagcttaagacatgaacccgtcctccgtttgccgccatttttaaactttggcggattgccgtcggatggcctgacatttcgcaaaccaagtccgccccttcaccatttgttaaagcgcttacatttttgagcggatcttctttttcaacggagatgatatcggttgcccccatttgcaatgcaaagtcgagcctgtattcatttttatcgatggcgatcacctgcgccgccccagacgcttttgcaactgccacggccatcagtccgatcggtccgcagccgacgacagcgactttcactccagccgtcattcccgtcagaaccgtatgcacggcatttccgagcggttcttgaatagaagcgagatcctcaggcatgccggccgggtttttccaaatgtttgcggcgggcattttgacatattcagcaaaacagccgtctgtatcgacaccgagaatcagcgtttttttgcagacatgctcttttccggtcaaacacggcaggcactttccgcaaacgatgtgcgtttctgccgaaacatactccccttcttttaccgtagtcacattttcccccacttgaacaacttcgccggaaaattcgtggccgaacacataaggcggtttaaccctgcttttcgcccattcatcccaattataaatatggacatcggttccgcaaatcgatgcggctttgactttgatcaggacctcgtgtttgtcgatcttcggaatcgggacgagctcgaagctggcgcccggctcccccggcttcttgataagcgctttcatatttccgtccaagatgaacagaccccctttgtaaaatcgctttacaaaaggattgtagcacgataatcagtcttggtaaacaccagtgtccttctggagaaaacagatgaacaccctctgaaaaatgtatgatatttttttaaaatgggatgcggctgatgaaattttgaaagagaaatccgtcgacttgacttggtgtatatgagcgctgcagcgcttcgatcagattcccgtaatctttgtgggcttcaagattcggaatgacacggtcgatgccgtcaaaatcagacccgaatccgatatgccgctcgcctcctaaagagcagacatggtcaatatgcgagaggatatctttgatcacaggcgtttttccgtttctcacgaattcagggacaaatgtcaagccgatgacgccgttcttatcaataagcgctttgatttgatcgtcttttaaatttctcggatgagggcaaaggctgtgggcattcgaatgagaggcgatcggatacgccgccgtttcaatcgcaccccaaaagcttttttcggataaatgggagagatctgtccatgcccggtttttgttcgccttgcgaatcagcctttccccgtaagaagtcaagccggcgtttctttcttctaaagcgccgtctgcgaacgtattggcccagttccatgtcaggccgaaacttctgactccgagctgaaaaaagatgtcaaacagccttaagttttttgcgatcggctcacagccttccatcgttaaaatgatgccggtttcatcgcttttgagcttgtcgatatcggctttatttttgatcagtttgatccgcttgtactttgcaattttttcgtgaaacagctggatctgcacaagcgccatttcaagccttattgtgtctggcacggtttcaggcagaaaaatcgccagacactgcactttcgcctttccgtttaaaagcgcttggaccggcgtttgaagcgacgggtcgctgtattcattgagcttcggatttttccagagcttcagcagcaaatcagagtgggcatcaaaaatcttcatgttcatcctcacccggctgatttttcaaaaacggacaaaccaaaaacaacccgcttacgtaaaagtaagcaggttgaagcatttgaaaaagagtgatctttctatcagcgaggctctacgattagcttaatcgctgttcgttcttcaccgtcaatttgaatgtccgtaaacgccggaatgcaaatcagatcgactccgctcggcgctacaaatccccgtgcaatcgctaccgctttaacagcctgatttaatgccccagctccgattgcttgaatttctgcagcccctcgttccctcaagactcctgcgagcgcacctgcgaccgagtttggatttgattttgctgaaacctttaatatttccattcctgctcccccttaagtttacaatggataagtgagtgttcattagaacaatcattattagatgttgctattttcaaagccatccccttttaattgcttttcaaaaatagcagggtaccttccatttttactatattcacgataggaccgggatattcctgctttccttttaatatttttctaaaatgattttctgtttagttattcaaaaaacatgtggtcgtcattaattaatatccggtcaattttaacggctttcttgctctgttcgtcgatgtcgatgacaactccgctcagagttgtgcggccttcggcaatctcaaaacggacgggcaggctcgttttaaaacgcttgataatcgtctcgcggtcgacgccgagaataccgtcgtaaggcccagtcatccccacgtctgttatatatgccgtgcctttcggaagaatgcggttgtccgctgtctgaacatgcgtgtgcgttccgacaaccgctgaaacgcggccgtccgtataccagccgatcgcctgcttttcgcttgtcgcttcggcatgaaaatcgataaagatgaacggcgttctttttgacgcttcttctattaattcatcagcttttcgaaatgggcaatcgatcgcaggcagaaaagtgcggccttgcaaattgatcacagccagttccttcgaaccgtttgtttttatgtatgtgatgccttttccaggcgtgccttcgggaaaattggcgggtctgacgatctgcggcgcatcatcaataaaatcaaatatttcccttttatcccatgtgtggtttcccatcgtgagaacgtcggctccagcttgaatgagctggtgatatattttttcggtaatgccttttccgtgtgcggcgttttctccgttgacgatgacggcattcggtttatatttgagcttcagcttcggcaaataggttttgatcatgtctctgccgggcgaaccgacgacatctccaataaataaaattctcataatttgaccctttctttttttaaataggttttaattatagtgttacacaaggaaacaaaaaaataaagtggcgcattcgcaccactttattttgcgtattcaacggctctcgtttccctgattacggttaccttgatgtgtccagggtagtcaagctcgtcctcaattcgttttcgaatatcacgcgccaaacgatgggcttcaagatcattgattgagtcaggtttgaccatgatccgcacctctcgtcccgcttgtatcgcgaatgatttttcaacaccttcgtatgattcggagatttcttccagtttttcaagcctgcgaatatagttttcgagcgtttcgcttcttgcgcctggtcttgcggcagacagcgcatcggctgcggccacgagcacggcgatgatggaagtcggctcctgatctccgtggtgagatgcgatactgttgatgacaactggatgctctttatacttggtggccagttccacaccgatttcaacgtggcttccttccacctcatggtcaatcgctttcccgatatcatgaagaagtcctgccctttttgcgagcgttacgtcttctccgagctctgaagccatcaagcctgtcagaaacgccacttccattgaatgtttcagtacattctgtccgtagctcgttctgaacttcaagcggccgaggattttgattaaatcgggatgaagaccgtgaactccaacttcaaacgtcgtctgttcacccatttcgcggatgtaatcatccacttcacggcgggatttctcaaccatttcttcgattctggcaggatgaatgcggccatcctgaacgagtttatcaagagcgatcctggctgtttcacgcctgatcggatcaaatcctgaaaggataacggcttccggcgtatcgtcgatgatcagatcgatccccgtcaatgtttccaatgtacggatattacgtccttcacgtccgataatgcggcctttcatctcatcatttggaaggttgacaactgaaaccgttgtctcggccacatgatctgccgcacagcgctgtaaagccaatgaaagaatatttttcgcctttttatcagcctcttctttcgctcgattttcactttctttcatcatgatcgcgatgtcatgggaaagctcgttttcaacccgttccagaatgatttgcttcgcttcatctcgcgtcagacttgaaatacgctccaactctgactgctgcatacgaatcatttcatccactttgctttccatctcttcaatatgttgttgtcgttcattcagagaatgatctttcttctccaacatcgcttcccgtttatctaatgattcatcttttcggtcaaggttctcttccttttgaagtaaacggttttcttgtttttgaagctcatttcgtctttcacgaacttcttgttcagcttctatccgaagcgtatgaatctcgtcctttgcttcaagaagggcttcttttttcaacgcttcagcatcccgctttgcgtctccaagaatttgttcggctgcatttcgcgcacctgaaatttttgcttcggcaatgattttacgaacatagtagccaacaactaaacagaataggctcagcaaaatggagatgagaattgctaaaggactcataactttcacctcctcttgctatgaacttgtcttgctaaaagtaagtgtcggcatgtacattgtacttcttctcaacatacagaaccttcacagggagtgaagcggattcacagcccttgtcaagtttaaatgtttatcaatcatgttaagaaaaacaagtgatacaatttcattgtaattgtgtgggaaatacttgtcaagcttacggtcttaacgtttctggattaaacgcctttcaaactgccctcatgaagaggatggatggaagagaagcgcctgaaagcgaagaataaagtaaaaggctgccgatcgggccggcagcctttcacacgtttcatgattaaaactcgagttcttcctgagcttgggcctcgtcttcctgtgcaggagcagcgcctccagtatccaaaccgtagtgctcccggatctgctcttgaatcatcaaaaggatatccttgttttctttcaggaactgtttggcgttttcacggccttgtccaaggcgttcctcctgataagagtaccatgcaccgctcttttgaacgatgtcaagctctgttccgaggtcgatgatttccccttcttttgaaattccttccccgtacataatgtccacttcggctgtccggaatggaggtgccactttgtttttcacgactttgattttcgtcttgttccccatgacgtcgttgccttgtttcagctgctctgcgcggcgcacttcaaggcggacagaagagtagaatttcagcgctcttccgcctggcgtcgtctcaggatttccaaacatgacaccgactttttcacgaatctggttgataaagatcgcgatggtcttcgatttattgatcgctccggaaagcttgcgaagcgcctgagacatcagtctggcctgcaaaccgacgtgggaatcccccatatctccttcgatttcagctttcggcacaagcgctgctacagagtcgatgacaacgatatccaccgctccgcttctgacaagggcttcagcgatttcgagcgcctgctcgcccgtatcaggctgtgacagcaaaagctcatcaatgttgacgcccagcttttgtgcatagacgggatcaagcgcgtgttcggcgtcgatgaacgccgcttgtccgccctgctgctgaacttcggcaatcgcatgaagcgccaccgtcgttttaccggagctttcaggcccgtatacttcaataatccggccgcgcgggtatccgcccactccaagagccgcatcgagcgctaaagaaccgctcggaactgttgaaattctcgtttcagtttgttcgccgagtttcataatcgaacctttaccaaactgcttttctatttgtttaagcgccatatctaaggctgcctgacgatcactcattctattttcctcctttatcacttccgctatatctactataccttgtttatgcggatttgccaagaaaaaagcgaacgcatattcgatttttttaagaggaaaaatcgatctcctaaaatggaatggcctttttcgaaagaaagatattccgaaaatccggtttccgcttatttttccatcattttcagcaacagatggcagccgtatttggcagaacgcttccgcaccgcagacctggatccggcgaactgaaattcgaacgcttcctcagcctggtccttcacggagatgccgataaacacctttccagccggatggccttcttgcgtattcggcccggctactccagtgaagctgatgccgatatcgcttcctgtcttgactctgatgcctgcggcgagctctttagcgcattgcgcgctgaccgcaccatagcgctgcagcgtgtcttccgaaacgccggccgctgacactttcaattcgtttgtgtagcagacggcgccgcctttgaaatattcggaagcgccgctcatttccgtcagccagctggaaaaaagcccgcctgtaaagctttccgcagcagccagagtcatacccttgctccggcatgctttcgcaagctcttctgcgagggatgtatcatcatacccgtaaaagaattctccgacccgctccaaaatgcggtcttccgtttcttttaacaagcggtttgtctcctccggatccgcatgctttgccgtaagcctgagcgtgacttccccgtctgccgcaagcggagcgattgtcggattagtctgcgcatcgatgagatcttccaaatcggtttcaagctgggattcaccgatgccgaagaagcgcagcacccttgacacgatcttttccctcgagccgagcttttccaaaatcagcggcttcgcttcgttttcaaacatcggctccagctctttcggaggtcccggcagaagcatataaaagcgcgattcatgctcaagcagcattcccggagccatcccaaagcggttcggcagaacatcggatccttcgaggatcagcgcctgtttgcggttgttcggcgacatctcccggttcgtttttttgaagtaatcctgaatcgattcgaaggcttcatcgtcgagcttaagagggcgcccgacaacttcggcgatcgtttcttttgtcagatcgtctttcgtcggtccgaggcctcccgaaaaaatgatgaagtcagacctttgctgcgctgtctgaatgacttgtttaaggcgctccggattgtctcccaccgccgtgtgataaaagacgttaatgccgatttcggccaaatgcctgctgataaactgagcatttgtattaacgatttgtccgagcagaagctcagagccgacagcgataatttccgcttttctttccaacttcattgtttccacttccctacgtttagttcgatgtttttaaagcatcccagtttttagcgaaataatcccagccggatacgactgtgaaaaagacagccacccataaagcaagagagccgaacgggaaggatacaagctcaaatgggagattgtgaagcaaaagggcagagatcgcgatgatctgggcccatgttttcacttttccaagcatgttggctgcgacgacttcccccgttcccgcaaggacgagccgcagtcccgttacggcaaattcccggctgataatgacaatggccatccaggccggagcaagatggtaatgcaccagaataatcaaagcggaagacacgagcagcttgtctgcaagcgggtcaaggaatttcccaaagtttgttacaaggttcagctttcttgcataatagccgtcaacccaatcggtgaccgaagcgaaaataaacagcagtgcgccgatcaaatgggtgaccggaatcgactcgctgccgaaggagacagccccccactgaaacggcacaagcatgatgaccataaaaacaggaattaatgcgattctagaaagcgtgattttattcggtaaattaaacataaaggttcctccatatatgtatgttttcctaatgatgatgaacgcaagaaaaagtcatctgtgcaattaagatgacttttcctcctttttattttgaatcgttatgttttgtgtcatcacagtcttaggatcgagcttgtaagaaagaacttctccgttgattttaatttcaacgcccggcgcatatccgatccgcaaatcaatttgcgattgatcggttatattcttttgaaaggtttccccttttttcatcattccttctttaagagagcttcctttctcgtcgcgcactctgacccatgagttttcgcttgcctttacttcaagctccagcttgtcggatcctgatacttcataggttgtggaagagccttcgcttgcggtcgctttaatggtcagcttgtcgttctcatcagactgctgatcctttttttctttgtcgccttcagcgctgtctttctgcgcatccgtgttctgttgattttccttagtcagcggggaatcttttgagacgtcgtacttgctttgcgattcctctgttttaggcccttcagcctgctgattccctccgccgtttacagcctgaacaatgacgtaaatgatcgcgatcacaacgataacgccggctgccacaagcaaggtgggcaaaagttcaagcgcttttgaggcagacttgggaagctccctctgcggcttgattgaagaaagcttctcagaaacctcatcattgtaagaattagggatatcttttttaaactcttcaaacaagtgctccgagtcgaggccgacagcttcggcgtactgcttgataaaagccctcacataaaatttccccggaatgatatcatagtttccttcttcaagggccgttaaataccttttttggatctttgtggccgcctgaaggtcgtccaatgacatccctttttcctctctggcttctttcagccgatttcctagttcagtcacaacaaacaccttccattttaaaaatcaaagccggaaaaacctgaatggtcaaacatctgcggttcttcagcgtgctcatatgtaatcacctcatcggggctgttacgcaattcgatgatgtagtcaaaatcgtccatcgtatattccgtattttgcacgaaaatgtccggatgctcgacaactttggtcgccggcagacgcataatctcactgacgagctgcaaatggcgttcagatcctcttctcgtcgacacaatgccgtccaaaatgaaaacattttccggactgtactcatcggcaatcagctggcttctgatcgtttgcttcagcagcgtcgaagaaacaaaaagccaccttttgcttgcacagacgcttgaagcaacaattgattccgtcttgccgacgcggggcattcccctgatcccgatcagcttgtgcccgtcttttttaaacagctcagccataaaatcgacaagcaagccgagctcgtcgcgttcaaaccggaacgtttttttatcgtctgcatcccgctggatatagcggccgtgccttacagcgagacggtcgcgaagcttcggttcgcggagcttcgtgactttaatcgtatccatcgtgttcaaaatcgattccaatcgcttaatctgatctatatgacggcattttaacaagaggcctcttctttgtgtatcgacgccgttaatggtcacaatattaattgaaagcatccccaataaagaggatatatctcccagaagtccgggacggttgacttggatttcatattctaagtaccattcgagctttgccaaatgataacctccctacccatcatcgtggcaaaaatttaccttcctttatcataaagcattttgtcttaattagaaagcagaatgttgtgattaaataagaaaaacgtccgtttcccaaaatcgggaaaaacctgctgtatcggcgcctgaatgctgtttaccctgtcggggcgaaaagcaaacgataaaagcggtgccgcaggcaaaatcgcgcctataaaaaagagagagtgaacacactctctccttaatgtgagctgttgttttcaacaagcttaaccatcacgttcgcaatggcgcgctgctcttcttcggaagccacgctccaaaggtctgcgagcactcgttcttgatggttttttgaatcaacctcaccggccaaataatcgccgatctcatatgcaagatctgagatggtttcttttgacattccttgttcttgggcatagttcaaacggtcgcccaaaaagtttttccactgatcccaattatccagtacggacatatcaggcccctccattctcttgaagttacagccttattattctcttgggaatcgtaaactatacatgtttttaacaatgccagccgccattaactgacaaaatttgacccgtgatataagatgctttcgccgagagcagaaacaagacggcgtctgcaacctcttcggcttcggcgagccttcccatcggaatctcatcggcgatcatctcttcttcctcttttgaaaatgagctcatcatctttgtttttacagcgcccggagaaacagcgttgactctgatgccgctcggcgcaagctcttttgcaagggctttgacaaacacattttgcgcgccttttgtcatgctgtataaaacttcgcacgacgcccctgtctcaccccaaatagagctgacggctacaatagcgccggactttttcctgatcatcgccggaagcagattcctcgttaatagaaacgggcttgagacatggagctgcaccatgtcctgtacagcttcatcggtcatatctgtcacaagcccgcggaagctttgtccgctgttcaagacgatgccgtctagcgcccgtccgccgatggaagcggaaacggtttttgcacctccggggtcggacaggtcgccgtgaatgatttcagcgtgaatgccgtatgtatgtgacagcctttctgcaagtgaagcggccgccttctcatttgtatgataatggaggagaagatcatacccgttttgcgcaagcttttcgctgatgctttgcccgattccgccgcttgcgccggtgatgagagcgagttttgtcataccatatttccacctttccgttaaaaaagaagaaaggttcagcgtgcatcggaaatatccctgcacgctgaactttcagaccttgctttatgattttggaacgactttgcagacggtgatcctgtcttcctcaacttcttcctcaatgacgcggtgaacgtcatcaagcgtaatcgattcgagtacggtgacgatatcaaacagactcgtctccagaaaagcgtaccgtgtaaactggttggcgatgtactcaggcgaattcatcgatttcaggaaattgccgatttttttctttctggccagttccagcttttcggctgtgatcgtttctttcgctttgaacagcacttgtttgagctcttcggccagcttgtcaggctcaggcgtatctccgccgacagagacgaagccaaatccgtgttcttcagtatagtcatagctgaatgtctcatcgatataccctttttcataaattctttcgtaatcgcttgagcttttgccaaacagacactcgaggatgaggttgatggtcagctcatgcttcagcagggcttctcccgtattcatcggatgagcgctttttaaaccgacgaggcattttgagctttgaacattcattttaatttcctgttcttttttaaatacggccccaggctctttaacttctttccggacgatttcaggctggtctgtatacggttttttctgctggttttcgcggacctggcgaatgatcgcttcgggatcgaccggaccgacgacaaacagcagcatattgctcggatgatagaacgtctcatagcattcgtacaaaaggtcttttgtaatatgagagatgctttcgatcgtgcctgcgatatcgatccggacagggtgctcttgatacatgttttcgatcaggccgaaaaacaggcgccagtcggggttgtcgtcatacatgttgatttcctgtccgatgatgcctttttccttctcaaccgttttttctgtaaagtaagggtcctgcacaaagtcgacgagcgtttccaggttttcttccacatttgacgtgcttgaaaacaggtaggccgttcttgtgaaggaggtaaacgcatttgccgaagctccctgcctgctgaattgctgaaaaacgtcgccgtcttctttttcaaagagcttatgttcgagaaagtgtgcgattccatcaggcacgcggaccatttcatcttttccgagcgggacaaactgattgtcaatcgacccgtattttgtggtaaagaccgcatatgtcttgttaaatccttctttcggaagaacatagacatcgaggccgccaggcattttttcgtaatatagtgtttccttcagctgttcaaattcgatcgttttcgtcaagatgctccctccgtccctttgagaaagtacgttgtatccaaatcgattttctttccgacttcgatgatgtcttcttttgtgacattgtcgattcgtcccagccagtcttccaaggaaaattcggtttgggcggcagcctgctgataaataaattcgactaaaccgtacggtgtatcaagcgtttcaagaatctggtttttaatgacggctttcgtctggtcgattgcctcttctgtaaagctgccttttttcatttcctgaaactgctccttgatgatgtcgacggctttttgataattgccgacttcaatccccgacatcaccatcaacagccctttaaagctttcgattctggaagccgcataataggcaaggctggccttttccctgacattaataaacagcttggaatgtgaaaatccgccaaacaagccgttaaacagctgaagcgccggataatcgtcatccgtaaaatgcgttcccgtccgaaatcccatgttcagcttcccttgcttgacatcagcatcctcgatgacttcctgaggctcccttgtgcgggtttgctcaagctcgggaacaggtctcagctcccgctcgtttgcttcaaagtatttggaaatgtacgaatccacctgctgctcatccacatccccaacgacgtaaatgtcgagctggtcttcgctgaccgctttttgataagcttcatacaggctttgaggcgtgatgccgtccacatcatcaagctctccgttgacgtgaagcgcgtatggctcatctttgcacatctcctgaatcagcctcaaatttgaatagcgcattttgtcgttatagaccgcctgtattctttgctttagtgtgcgtttttcctgagacacgtacagcggcagaaaggccccgtcttcaagcgccggcgaaaaaatgatctctgacaaaagctcaagccctttttccagaagcggtgtctgatcctttaaaaatttttcgttagcgatatcgagcctgaatgtgatgacatgcatttccccttttttggagagatcgcatgatacggaagtgccgtaaagttcatcaagatacgatctgagttcggccgttttggggcgggtgctcgttccccgcaaaagcacatgcggaaaaagcgccctctttgtcacatcctcttttgttaaaggagcaagcattttaaaaataatcgagacggttttgaatttttccgttttgacaatgtggcttgtcaatccgcggtgctttccttttatttcgttaaggtatgtcatactagaacctccttcgtccttgtttatattatgtattatgaccacatttcagcatatgccttggactgtatggttgtaattatatcaactggaggagatttaaggaaactaaaaaaccttatgaaaaagacggtgcagatctacaccgtctttgccgcttcactttcgtcttctttcgggtcaatattaaacagcacaagcgctagtgcagctaaactgcacaaaagcgatacgatgaaaatcagccaccccgcatttgtcatcatataggcgaaaaccggcggtccgagcgcaacaccgataaacctcatgctgttgtaaaacgaagatatcgtgccgcgctcttctttttcaattccctcggtaatcagcgcatccaaagaagggagcgcaattccgatgccgatgccgccgatggacataaacaaaaataacgggtaaaagctgtggttccaccacaaaccggcaaacgacaaagccagcaggatcatgccgatcagcacgcagatcctcattctgatcttatcgtttccgatcagctttccggcaaggtaggaactgacggaaagaaaaagcagcggaatgctgagaagcgctcctttcgcaatcccgtcaatttgatgcttcttctccaaagtatccgacaggtagaagagcactccgaataaaagaaacataataattccgccgatgacaaaagtggaaacaagccaccgaccttcccgtttgaaaatttcctgtacgctttttgcaaagttttttaacgtttgcttttcatcatctttgtccttcggtttgggaacaaaaaacaagacgagaaaaaagctggcaagagacacgaccgggataaaccaaaacggcatgtaccaaacccaagatgctaaaaaagcccctaatatcgggcttaatactttgccggcagtatttgccgtctctatatctccgagtcccgcgctgatttcttcatcattttggaacaagtcgccgataaacggcatgacgatcggcgctgcgccggctgagccgattccttgaaggacgcgacctgctaaaatcatcgcaaacggatcattgaaaaaagttgaagccaaacctgctaacgctcctccagctcccgcaatcagaaggcatgggagcatgatcttttttcttccgaaccggtccgacatatagccggtaatcgggatgcatacaatcgccacaattgaataaaccgtgatgatcaacgacacctgaaacgaagaaatgtttaattttttttcgatcaccggcaaaaccggaatcagcatcgaattgccgagcgtcatcacgagcgggaccgaagacagcgcaaaaatgcttttcatgtctttttttctgctcaacttttttcacccaattcatcagtatttccatctgttattgttccatgatgcgggcttatttatgtataggcgctcaagcgggcaaaaaaaacacgctcctaatagagcgcccgcatatcaaaaacgttttctgacgacatgaaatctgaatttatcggccctaaaatagtttaaagaatataaaacgggcttatcgttttggtcataatgagtctgtttgagcagcagcaaagacgtttcaggatcgcattcaagaatttgggaaatggtgtcatgatatccgattggcacaatatcggcaacagcgtagctgatcacggcgccggatttgttctcaagccattcaaacatcgattcctgctcgtgtgaaaagccttccgggagaatgtccacaggtattttatcaagacagtagacaaccggcattccatttgccgttctcacccgctcaagcaaaaagatctcggtttcttccgcatattgaaaccggagcatatcttcttcagtgggagcggtaacctgtgaggacataaaaatggttcccggcgtcatgcttgcctgctcgatcatttttgtgacgctgttcagctgctcaatacctgatagaaataacggtctggcatttacaaaatgtccgactccatgccttctgatgatgacgttttcttcttccagtattctaagcgcctcacgcaaagccgttctgctcacaccaagcatctttgacagctcaaattcactcgggagccgttcattttcgcaaaagaccccattttgaatatcatcttttatccgatcaatcacctttaaacataaccgttgattgtcagcttttatcgacatgttttccctccgtctgacagatcagattcaaattatctttaattgaggataactatatcatgttttgtcaaataaataaatagatgttttttagtttacataatgaaattatgttaaacaagaactctcttctcaagaagagagttcttcgtattgctcttttgacaagagaacttcacggggttttgatccttcatatgggccgacgattccccgctcttccatggcatcgataagccgcgccgctcttgtatagccgatgcggaatctcctttgcagcatggatacagaagccgtctgcatgctgaccacaagtgcgaccgcttcgtcataaaggtcgtctgtcacttcgctgaccgtttcctgcgtctcttctggaatcatttcttcttggtattgggctttttgctggctgatgacgtgatcgacaactttttcaacttcttcgtctgacagaaaggcaccttgaacgcggagcggtttattggcgccgacagggagaaacagcatgtcccctctgccgagaagtttttcagcgcctcccatatcaagaatcgtcctggagtcggtctgagacgatacgctgaaagcgatccttgacggaatgttggctttaatgacccctgtgataacatcgaccgaaggcctctgcgtcgcaatgatcaggtggatgcccgccgccctggccatttgcgaaagccttgtgatcgagtcttcaacatcagaggaagcgaccatcatcaggtcggcaagctcgtccacaatcacaatgatgtatggaagctccggctgctttgcttcttctgcggcattcatccgtttaatatagtcgttatacccttcgatatttctcgttcccgtgtgagaaaacaattcgtagcgccgctccatttcgttgacgactttcttcaaagcctgcgatgcttttttcgggtctgtcacgacgggagcgagcaaatgcggaatcccgttgtagacattgagctcgaccattttcggatcaatcatcatcatcttcacttcgtggggctttgccctcatcaaaatgcttgtaatgatcccgttgacacagacgcttttcccgcttccggtcgctcctgcaacaagaaggtggggcattttgttcagctctgccaataccgcttctccggaaatgttccggccgaggccgatcatcagctttgcatccggccggtcattcagtttcgattcaagcacttctttcaaggaaaccatcgccacttccgcattcggcacttcgattccaatcgccgattttccggggatcggggcttcgatgcggatatccttggccgcgagcgctaaagccaagtcgtcacttaagttgacaattttgctgactttgacgcccacatcaggatagacttcatatttcgtgacggccgggccgagatgaacctgggtgactttcgccttaactccgaagctttgaaacgtcctttccagcttcctggcattgtcgtaaatattctttttatccgcctgctgccctgtgtgcttcggatcatccagcaattgaatcgacggaagctggtaatccttgttttctagctctgtaaacgtgatttcgggcgcgccggaggcctgcatttcctcaccgatttcgggctcagcaggaggttcagcaggagccgccggagcttcgtaagcttgaacttcgggcttttcatcacggtcggaaaagcttgaaataatcggttctgattgaataaccggatctggatcaaggtccgcttcttgtacaggctcttcagacactttcggttttctctgcgtcttttgtttttttccggatttctttttcggcgagctgtttttcaattgtttaagatctgctaaaaaggcctgccactggtttttcatgaaggaggcgaccggggtcatccatttgatcagcgtctcctgaagcgaccgatccgtaatcaaaagaaggccgatcaagatcaggaagacggcgatgattttagatcctgcagatgcaaacagaaaatatgacgccgcgaataaaagggctccaatcattccgcctccaagatcaggcgatcctgtctcgccttttacatccatcagaaacagctcccacgtattttggatcacgctcggagactgaaccattcccctttcggtcaaatgctgaaacagctggacatgtgaaagaagcagcatgcttgcaatgatgcagtaaaggcccgcttttctcctcgtcaaaaaactgggtgttttctttttccaaaataaagacaagcccgttaaaaagaggccgagaaggcaaaggatgaaccattcaccggcgaaaaagcggaacatgtaaatgaacgtttgccctgctacgccaagctgcaaaaccgcaataatcgagatggcgatacagattaatccgtacaattcaaatttaagatggatccgtttttttccttgtttttgtttctttgttgattttcgttttctttttgccatgttccatcaccttactgcgtgttaaaaaatgtaaaaacaaagagaaagcagccttttttcggctgcgattttcctctggattcccctattatagcatatttatccttgagacactccagctatttataaaatgtcagtttaagcgtctgcccaggggccgtttcttgttttaaaaaatccatcgggttcgtgctgagaacctgaacgacccttgcttcctctccgttcatctcgactaaaaggggcacgccgtttacatcgatctgttttaagttcgagttttccgcctgccctgcgaacacgatttcctgcggcattgtcgtatacagaatcattggatcatcccttcctgggcgcccttgttttgttcgattaattcattcagcttttgaatcgcctgtccgactccgccggtttcatcgattaatccgtatttaaccgcatcgtttcctacgacattcgtcccgatgtcacgggttaaattgccttttgaaaacatcagttctttaaatttttcttccgatatgttggaatggcttgtcacgaaattgatgaccctttcctgcattttgtcgagatactcaaatgtctgcggcacaccgatgacaagccctgtcagcctgaccggatggatcgtcatcgtagctgtttcagcgatatagctgtggtcgcaggacactgcgattggaactccgattgaatgtccgccgcccagtacgatagagaccgtcggctttgacagggacgccagcatttccgcaatcgcaaggcccgcttctacgtctcctccgaccgtgtttaagatgatgagcagaccttcgattttaggattctgctctactgcaacgatctggggaatcacatgttcatactttgttgttttgttttggggaggaagctggacgtgaccttcaatttgtccgataatggtcaggcagtgaatgttggtgtcctgccccatctgcgggagtgtcgtttcgccgagctgctggattttgttgacgagactgtcttttgcgtcctgcttagccggctgctccccttggctgtccccgttttgtatccggtttgaatccatctggctcacctctttctcgagtttcttttgtattatggacaatggcgtttttttcattcaacgcaaaaggcatgaaaaaaaaccaagaggagtctcttggttttttatacttccatgatgattggaatgatcattggttttcgtttcgttttttcgtataggaactggtttaatgcctcacgcatcgtctgttttaaggcggaccattcgacgacggcgttttctgtgctttcgttgacgagttccctgacaagctctgtcgcttcaacgatcagctgttcagattctctgacatagacaaaacctctcgtgataatttcgggtcctgaaactagatgttttttctttttatcaagggtaatcacaacaattaagattccgtcctgggatagcagacggcggtctctgagcacgatgttgccgatatcgccgacgccgagtccgtcgatcaatatattgcctgagtgtactttatcgccgattttaacgttttgtccgcggaattccacgacatctcctttttcaatcaggaaaatgtcgctccgtttcatgccgatttcttcggcaagcttggaatgcgctttttgcattctgtattcaccgtttacggggattaaatacttcggcttcagcaagttgagcatcagcttcagctcttcttgacagccatggcctgatacatggacgcgtttttgtgcgaatacgacctgggcgcccgctctcgttaagagatcgaccgctttggagtaaacaagctcctgacccgggataggggaggatgcgatcaggacggtatccccttcctcaatgtcaagctgcttatgcccttgttttgcgatcctggtcaatgcggcgagcggctctccatggttgtcccctgtcaaaatcgcgacttctctttttggatactttttgacttcttggacagggatgaacatatcttcatctgccgtgacatacccgagtttcatcgccagctggagtatcgccgaaatatttttccctgaaactgcaagcttcctgccgttttgcagcgcggcatcaatcacctgctgaatccggttaaagttagacgcgaacacggcaataatcacgcggttttcggcgttgtacatcacatcggatatctctccgccaacgagtgcttctgaaggcgtatagcccggcttctcggcattggcgctgtcggaaagcaggcacagcacaccgctgttgccgattttggcaatttcgccgatgtcgcttgtctggtttaacacaggtgtctggtcaaatttaaaatcgcctgtgcacacgatggatccgagggatgttttaaagctgacaccgacggaatccgggatgctgtgatttgttttgaagaatgacacctttgtcgattcaaatgtaataacggattttgaatgaatttctcttaaatcgggctttttgtttacaccgtactgcttcagcgtttcctttaaaagggcaagcgtcagcttcgttccgtaaacaggcacagaaagcttgttcaggcagtaaaatacgccgccgatgttttcttcatgcccgtgtgtgagaaaaatcgcctttacgcggtcagatcgttcaattaaataagaaatgtcagggatgaccacatcgatacccagcatttcattttctggatgcatgaggccggcgtcaaccacgaatatgtctgaatcgatttcaatgacatagaggttttttccgatctctccgacgcctcctaaggcgatgattctaatattttctgtattttttttcaaattgtaatcctcctaatctaagtacccgtccatcatcacttgtccctattatacctgaatctaaatttagaaaacaagaaccattatgtatatgacaaacggtcatcccctccaaaagagaatgaccgttttcgtccgtattgttttttacaggccgttcatcaggctgcttaaacggagtcgttcatcttcatttagcggaatcaaagggagccggacggacccgacgtcaagacccttcagctgaagagccgtctttaatggagacgggttcggtgcggcaaaaagccctttcatcagcggaagcagcttttgatggatcaaagcagcctgagccgtgttcccctcggtataatgtttgatcatttcctgcatttccggtccgatgatgtgtgatgcaacggaaacgattcctctcgctcccacggacagcgccggcagtgtcaggctgtcatctcctgaataaactgcaaagtcctcaggggtttcggctacgatttttgttatcgcatctaggtcgccgctcgcttctttaatggcgataatattcgggatctccgcaaggcggattgtcgtctctggtgcgagcgaagcagccgttcttcccggcacattataaagcatgacaggcagcgatgtttcctccgcaatcgctctgaaatggcggtacatgccttcctgagaaggcttgttgtagtacggagtgacgagcatgacagcgtcagcgccggcttcttcagcttttttcgtcagcttgatcgacgccttcgtgttgttgcttcccgtgccggcgatgattggggcacggcctgccgcttccttgacagagtattgaatgagcgctaccttttcttcttcggaaagcgtcggcgattctccggttgttccggcaacgaccagggaatccgtcccattgtttagtaaataatcgatcagctttgacagtttttgaaaatcgatattttcatttttgtcaaagggcgtaaccatcgcggttgcgatatttccgaaattcatttttttcacctcatcatgattcaatcatatttattttgacagttcaaacacttcatgcagcgcatttacggccgtcgccatatttttctcgtgcacgagcacccatatcgtcgtatggctgtcagcagactgcaggatcggaatgcctttttctgacaaagcggtaacgatttttgaggtgacgcctggaacgcccataatccccgcgccaaccgctgacactttcgcgcaatttctcgtcacggccggttcatagcccaattccttcaggatgctgtgggcgcggtctgtcatgtttccagccaccgtgtagacaatttcacttggtgtaatattgaagaaatcgacgctgatgcccgcattcgccatcgctttaaacacttcagtctgtacgttatattgtccttcttttgccgggactttaaactgtgtcacgtctttcacatgggcgatgcctgtgatgagctgctcaaaaacgtcgcttccggctttcgagttgtgatggcttgtgacgagcgtaccggtttcgtttgaataggttgaacgcacgcggatcggcactttcgcctgcattgcgatttcaacggctctcgggtggatcaccttggccccctgataggctaaattacagatttccgtataggtaatcacaggcagcggcttcgctttttcaacgatgcgcggatcagctgtcatgacgccttcgacatctgtataaatatcgataaattccgcgtccagagccgcgccaagcgcagcggccgatgtatcgcttccgccgcggccgatcgttgtgatatccccttttgcagtcgcgccttggaagcctgcgacgacgaccgcatcatggtcggccagcatgctgacaagccgctccggcttcatttcgagaatctttgcattcgtatggttgttgtctgttaaaaagcccgcttgcgcaccggttaaagcagcagctttaatcccgttttccaaaagcatgctggcgaacacaacagaggaaatcgtttccccgcatgataaaagcatatcctgctcacgctcggtaattgtatcctgtccgccgtaaagcagatcaagcaatgaatcagtcgcatacggatcgcctttccggcccatggccgatacgacgacaaccgctttgtatccttcattgaccgcttccttaatatggtttaaggcaagctttctgccgcggtcatcttttacagacgttccgccgaatttttgaacgatgattttcactttatttcactccaagttgatttcggacgtaacagaagagagcaggccttcatttttgcctcactctcttctcacatcccgttagaaatcttaaactaaatttaaagcttttaggctttctgcgatttgtacggaattccatgccgcgcctttcagcaggttgtcggaaacgatccacagatggaaaccgttcgggcggtcaaggtcttttctcacccggccgacaaatacgtctcttttccctactgcatctgcaggcatcggatagacctgtttagctggatcatcctgcagaacgacgcctggagcttcttttaacagatttttaatatcctctgctgtcacatcatcacggtctgtttcgatgtagacggattctgaatgccctgttgcaatcggcagtctgacacatgtggctgaaacttgaagctcaggcatgtgcatgatttttttcgtttcatttatcattttcatttcctcaaacgtaaagccgttttcctggaatttatcgatttgaggaatagcgttaaatgcgatttggtagtgtttttcatcactcttcaccggcatgatctcaggctcgaacggtttgtcgttcaaaatggcttcggtttgcccgtagagctcttttacagcttcgtttccggctccagacaccgcctgataagtcgatacgatgattttgtttaaaccgaaagccttgcggatcggttcgagcgcaacaaccatctggatggttgaacagttcggatttgcaataatcccgttgtgcttgtgcaaatcttcctcattgacctcaggtacgacgagcggagtgttttggtccatccggaacgcgctcgtattatcaatgacgatcgccccgcgtttgacagcctcgtgagcaagcgcctgcgaaacgcttcccccggcgctgaaaagcgcgatgttgacgccttcaaagctctcaggacgagcttcttctactgtgtactcttcgcctttgaaagtcagtttcgtacctgctgaacgttttgaggataataaagtcagtttatccagttcaaaattcctgtcttctagtgtttttaacatttgctgtcctacagcgcctgtcgcaccaactactgctacatgtaatcctctgcccaattgtaaaactccttccaccttaatcgtcgtaaacgattggttgactatgcattttacattttattttaacatagatgtgtgccgtggtgattgatattttttgttacatctttattttcaaaagatttattgatcattatggaccaggataggctgtatttgtttatgggagagcgcttcttcgaccgccggcactaaaagatccattttggcgacgagcgaattcggctttttgtaagggtcatcctggccgaacggaataaagtaaacattttttgccgccatcagcctcatcaagttgacgccgttcaagccgagcgcgtcattcgttgaaatgccgaggacgacgggacgggagtttctcatcgtcgctttggccgccatgagaaccggactgtccgtctgggcgtttgcaagcttgctcatcgaatttcccgtcaatggcgcaacaaccatgcagtccagcggtgttttcggcccgagaggctcagctttcggaatggaatcaatgacttcaaatccagtcagctcttctattcttctgacccattcttccccttctccaaagcgtgtatccgtcgacttgacagtatgcgtcacgaccggtctgacttcagcccctttgttgatcagcgcttcaatctgcggaaaaacggcatcatacgtacaatgtgaacccgttaggccaaatccgattctttttcctttgatcgacattatgacagcccctttcggtcagttgttaattcagacaaaaggttgcacaaaacattggcaatgatctgtcccgccgttttaggcgcgacgatcccgggaagtcctggagcaagcagcgctttaatgccttgcttttcggcaaaatcaaaatctgtgcctccgggacgggttgctaaatcgagaattaatgttctgggtgtcattcgtgagaggacatgtttatcgagaatcaggcttggaatggtattgatgcatatgtcgatattttcaacatgctctgcaagttcgtttgtgtggaaaggagtgaggcccatctccatgattctggcgaggtgggcggagtcgcgagctccgacttttacgcgtgcgccgagcgccgagaacgtccggctgatgctcattcccgtccgccccagcccgagaaccattacattcgagccgtgaatcgtaaagtctgtatgctgtatggccatcataatggcaccttcgactgtaggtatcgagttgtaaatcgcaatatcgtctctttcaaagagcttgataagacgacggttcgcccctttggccatgccgtctaaatattggtttgaaatccctgaataaatcgcgcagtgcggcttggttttttctaaatgttcctgttttaacaccactttttcattggaaaaaacagtcgcaaccgttccttccatcgatgtgcccgatacaggcagaataatgctgtctattgtgccaaaatcaagttcgttcagctttagttttgtagctccggtaaacccgtgatcaagctgatcaaaaccgattaaaaagacctttgcatcctgttccgtcagcttgcggatgatctcgagctgccttgcatcgccgccgatgattgcaatcgtcaatccggttaacatggctctaacattcaccttcttttttgacaaggatctaattcataagctaatttcatcatatgacaaaaaggaaatagcggtgaattgaaatccagaaaaacaaaaagcccgcccccatgggacgggcgggtttccaccttgcttactcctcttttgtcacgctgctttccggaacatccaaaatgatcatatccgagccgattttttgaatttgcgaccagggcaccttaatgtcattcccctgttttcttcctagtccgaaccatttaacagaagggatgataagagcggtaatctgaccgtcctgctcattgatctcaaggtccgtctgccccagtacgccgagccgttcggcccgcttaacatcaacgatttcttttcccgaaagttcactcagcctcatgaaaaaaacccccttttgttatgatgtatgaaccgataacaaaaaacatgcctgcctaaaaagacaagcatgttttaaggaggcattatttcggcagctcacccgacgggctgattaatgcagatgagtaatcatcggtgaaaatccggttggcaagattgttcacacgctcgaggctgacggcattcaacttttcgatgatttcatcaagcgtccggtgtttaccgagcaaaagctcatttttgccgttgcggctcattttgctgtttgtgctttcgagactgagcatcaggctgcctttcatttgctctttgctgttttcaagctctttcggtgtaataccgtcgcttttcagcgcacgcagtgtttcatgaatcgtttctgacaggagctgaagctgatttgcgccggttcccgcgtagatggtcatcatgccgctgtcttcataggaagtgtggtagctgaacacggaatatgcaagacctttatcttcgcggacatcctgaaagaggcggctgctcatgcttcctcccaaaatattattgagaacgatcaaatcgtagatttccggatggcctgcttccagcccgttgaagccgaggcagaggtgagcctgttcggtttcctttttgcgcgtcattttctcatggtgaaaatccggttttgtcatgccggttcttttgcctttggcttcatatgaaccgaaatgcttttcagcttcttttataaaagtttccggcacatttccggctatggaaatgacgactcggtcaggcgtgtaatattcgttcatatattttctgagcgaatctccgtcaaattcggcaagtgtttcctctgtgccgaggatcggatagccgagggaatggctgccgtatgacgccttgctcaagagatcgtggacgatgtcatcaggtgtgtcctcatacattttaatctcttcatagacgacgtttttttctttttttaattcttcttcgtcaaatgatgaatgaaagaacatgtcagaaagcacttccagagcatagcttgcatgctcatcgagcactttggcgtaatagcacgtatattcctttgaggtaaacgcgttgacctgtccgccgattctatcgaaagactctgcgatgtcccttgcagtgcgcgtttttgtccccttgaaaaacatgtgctcaagaaagtgcgaaatgccgttaatttcgggtgtttcatgtcttgatccggttccaatccaaactccgatggccacagaccggacggtgggattgttttcgaatacgattcttaccccattttgacaagtataccgtttaatcaaatttgttcctcctattcaaagaacgggccgcacatcctattcttcaacaagccttttttcattcatcagctgtgaaacagttccgatttgatagcctttttcatgcaggttctgtatcaaaacggcaagactttttgcagttggatctgtcggatgcattaatatcatggcgccgttatgtactttgcttaatacccgttgctgtaagacggccggctgcggtttctgccaatcgatcgtatcaactgtccacatgatcgttcccatccccatcttgtgagcctgatccacaacctctttgcggaagctgccgctcggcggggcgaaccacttcggcttgacgccaagcgtttcctgtatttgttcatttgtcatccgcagctgttctgaaatacgttctctcgtcagtttgctcatatccggatgattgtatgaatggtttccgatttcatgcccgccgttttgtatggctttggccagctcggggtgatgcttcacccatctgccctccagaaaaaaggtggctttgatacgatgctgttgtaagacgggaagcatctcttctaaatattcattaccccaagcgacattgataataaacgataccatcggtttatccgggtgtccgcggtagatcggctcaggctttaaggattctaaatgaacgtcaggcttcacttggtcataaacgagcagtttctcatcaaattcaccggcctgtttcatttttttgtacgatttttcgatgtttacttttaagccgttgtagccgggcatcgctttccatatgtgatcaattttcgcattctgggccttcacttcatattcaggcgctttttgcaaaagctcctggtacaaatcgtccttttgagcggcaaccgtgaccgcgtcttttttcatcgcatctatgtaatgttgtgaatacggacggttcatcatctgataggacatcagcaaaagaaagaaaaaaacggaaatccgaacaatcgttcctttcaattgtattcctcccttccccacaaaatatgtgagaaaaggacaagatagaaccggaccgttttcacggcttaaaacaaagaagccgggttacccaggcttcctgttgcttgaagacgaagacagaagcaagatagacaccgttttttttacgatttttgttcttctttttccttctgttcacgcagtacagcttttcttgataagttgacgcgtccttgtttatcgatttcagtaacctttacaaggagctcgtcgccgattttgacgacatcttcgacttttcctacccgttcgagcgcaagctctgaaatatggacaagaccgtcttttccgctgaacagttcaacgaaagctccgaatttttcaatccgcttcactttacctaagtaaagctgtccgacttcaacttctctgacaaggtcttcgatgattttcttcgctttttggttcatgctttcatcggtagaagaaatgaagattgtgccgtcttgttcaatatcgattttaacgcctgtatcttcaatgatcttattgatttgttttccgcttggtccgatgacgtcgcggattttatccggattgatcgacatcgtcaagattttcggcgcataaggagaaagctcttttcttgattcagccaatgtgctcagcatgctttcaaggatctccattctgccttttttcgcctgctgaagagcctcttccaaaatctctctcgataagccttcgatcttaatatccatttgcagagctgtgacgcctttggacgttcccgccactttaaagtccatatccccgagatggtcttccataccttgaatatcggttaagacggtatagttgtcacctgatttgacaaggcccatcgcgattccggcaaccggggctttaatcggcacccctgcatccatcatcgctagcgtgcttgcacaaatgctcgcctgggaagtggaaccgtttgattcaagcacttcagagacgaggcggatggtgtacgggaagtctttttcagacggaacaatcggctcaagcgctcgttccccgagggctccgtgcccgatttcgcggcgtcccggcccgcgcatcggccctgtttccccgacgctgaactgcgggaagttgtaatggtgcataaagcgtttggattcttcgacgccgagaccgtctaaaatctgcacatcgccaagcgcaccgagcgtacaaatgctgagcgcctgagtctgtccccttgtaaaaagtcctgaaccgtgtgttctcggaagcagtccgacttctgaagaaagcgggcggatctcatcgacagccctgccgtcaggacgaactttttcctccgtaatcagacggcgcacttcatttttaacaagctgggacaaaatgtctttcacttgtttcagcgtttcttcatcgtgttcctcttcttcaaacttggccaaaacctcgtttttcacttcgctgatcgcgtcctcgcgcgcatgcttttcatgaacctgaatggcttttaagaggttcgattcggccattccccgcactttttctttcagatcggaatcgatctcatacagggtgatttctgatttttctttcccgacagcggcgacgatttcctcctggaaggcaatcagccgtttgatctcctcgtgaccgaacatgatcgcttcaagcatgatctcttccggaacttcgtctgctcccgcttcaaccatgttgatcgcgtccttcgttcccgctacgacgagatgaatgtcgcttttttcaagctgttcaagtgtcggattgatgatgaatttgttgtcaacccggcctaccgtcactccggcgatcggcccttcaaacgggatgtcggatacgcacagcgcaagagatgatccaaacattgccgccatttctgacgaacaatcctggtcaacgctcatgacgatgctgacgacttgaacttcattccggaagccgtctgcgaacagcgggcggatcggcctgtcgattaaccggctggcgagaatcgctttttcgctcggtcttccctctcttttaataaacccgcccggaatctttccgacggcgtaaagtctttcttcgtaatttacggttaacgggaaaaagtctacggttttaggttcttttgaagccgttgcggtgctgagcactgcagtgtctccataacgcaccatgacagctccgtttgcttgttttgcaagctggccggtttctactgtgagcttgcggccggcccaatctatggaaaagacatgtttctcttgtcccattcttatatgaactcctctcttcggatagtttttaggttactcctattatgaacgaaatgaattgaacatatcaatggcaaagtgctatgtaaagaatgaatcggtgtcatttaaaatcatttatatgaacaacgcgttttagagttgccggatattcgttcttatacgataaaaaagcgggaatcctcccgctttttacgattatcgacgtaatccaagtttgttgatcaactcacggtaacgagttacgtctttgttacgaagatacgtaagaagattacgacgtttacctaccattttaagaagaccgcgacgtgagtgatggtctttcttgtgagtgcgtaaatgctcgttcaagttgttgatttgatctgttaggatagcgatctgaacttccggtgatcccgtgtcagattcgtgggttttgaactcattgatgagttgtgttttacgctcttgagtaattgccatcctgtttcacctccatataatattagccccgattacctagcaaacgccggtgattcgatttgccaagtgaacggttttaaagctacagacaatatgatactaaaagttcgggtctaatgcaaccatttatgatgaagtttacctttttatcaccattgttgacgcgtattgccgtttccatacatctagattccggccggcttccgctctctgaagaagcggatcgcttcttctttgtctctagaaatctgttcgacaagctcgtcaacgctgccgaattttttttcgctcctcagccgcttataccattcaaccttgatttcggagccgtatatgtcacggtcaaaatcgaataagttgacttcgattgaaggctgacccggccgtttttcgtaaaacgtcggcttgtatccgacattgcagacgccgttgtagacagcgccgccgatttcggctttaacggcgtacacacctgtcggcgggacgatgtatgtgtctttaaggccgatattcgcggtcggaaatccgatcgtgcggcctcttttatcgccgtggatcacaaagcctttcacatggtacggcctgccgagcagttcagcagcgtactcgacgtcaccggctcccagaacgctgcggatcctcgtggagcttaccttttgatcctgattggaatattttgcgacagacgtgcttttaacacggcctttcgcatactcctggaagttttccatagtgcctttgccgaatttcccgaaggtaaagtcaaatccggctacaacatgagtgacatgaaagccgagtatatattgatcgataaattcctcaggtgatagagaagcgaattcaggggtaaatgtgacaacgtataaaaaatcgacccctaaatcttcaatgatgctgattttgtcttgcaaaggcgtgattaaatccttcggctcccggccttttttgagcacggcagaagggtggggatgaaaggtcatcacggacgttttgaccccttctcttgccgcggtgttttttgctgtaagaatcacttgctgatgtcccaggtgaacaccgtcaaaataacctaatgccataactgatgtcggaaaatcctcacgcttcaagtcgtgtgggtgggaaatatgtatcgtcttcaagaacggtcaccttttctattgttcgcttttttgcacgagtacttttgccggcttcaacaaaccggttttggtcggatgcggataatagacggctgtgcaccggcctgcttccgtaaagaccgcaatgcggtcttcgctcgtcaaatgagaaaagctgccgggcgtttcaagcaccgctccattttccactttcttagctaatgtatcactaattatccatttcggcaaatgatcaagcgcacgttcgatggggacgagcttttcagacaatgttccgtcagcgatcaagccttcgacgtcttcaaaggtcaagcattcgtcaagggtgaaagggcctgacgcggtcctgaccagattggacatatgcgcgggatatccgagcttctccccgatggttaccgccaaggtcctgacatatgtgccttttgaacatgtcacaacaaaccggaagcgggctttatccccctcatggcggatctcggatgtcagttcgatatgatggatggtgatggtccgcttcggccgttcaacctcgattccagcccgcgcgtattcatacagctttttgccgcctaccttgacagctgaatacatcggcggaacctgctcaatcgttccttcaagagatctcaggacgctctgcacggtctgttcatcaggcggcgctaagacgggtttcttttctgtgacttcccccgtctgatcctctgtctccgtggaacagccaagcgtgacctctgcatcatatgttttggacttttcggtcaaatactcgacgattttggttgccctcccgacgcagatcgggagaacgcccgacacctcgggatccagtgtaccggtatggccgaccttttttgttttcagcagtttgcggatcttcatgacgcagtcgtgcgaggtcatgccgaccggtttatgtaatagaaggactccgttatacattcgtgcttcttcgcccctttctcatttggagctaaaaaggacaggcagtcgcccgcctatcctttttcagcttatgattcttctttgtttgcgttcagctcgtgaatcaatgtttcgatacggtttccgtaatcgatcgattcatcgaactcaaaatggatttcaggtgttttgcgaagcctgattcggtttccaagttcggaacgaataaagccctttgcttttgccaggcctttgagcgtttcttcccgtttcttttcatcgcctaaaacggaaatatacactttggcaatttgcaaatcacctgagaccctgacgtcggtgactgttaaaaatccgattcgcggatctttcagctttctgccgataatgtcaccaagttcttttttcatctgctctcccacacgggtagctctcatcgtcatgaccataccacctctacgttaaaaccactctgttctcgtgatcgtccgttcaatttccggaaaagagtcaataaaggcgaggacccgctgcagctctttttccgtttgcacgcgagaggaagaaacggcggcgataccaaagcttgtgcgctgccaagtgtcctgatagtcaatttgtgaaacagaaacgttgaacttggcgcggattcttgtgatgatccgcttcagcaccgcccgcttttccttgagtgatgatgcatcgtaaatgatgcattcgcattcaacgaaaccgatcactttctttcaatttcttgcatgacatacgcttcgatcatatcgccttcgcgtatgtcgttgtatttcttaatggtgataccacattcatagccttgtgaaacttctttgacatcatctttaaagcgtttcagcacatcgacttccccttcaaagatgacgacgccgtcgcggatcaagcggattccgctgtcgcgcgtgatcgtaccttccgttacatagcctccggcaatcgttccgattttagagactttgaatgtttgacggacttcaaccatgccgatcactttttcttcatactcaggatcaagcatgcctttcatggctgcttcgatctcatcgatgactttataaatgatgcggtggaggcggatatccacattttcggcttcggcggtactcttagcatttccgtcaggtctgacattaaacccgatcacgattgcatttgatgcagaagctaaaataatgtctgattcggtaatcgcacctacgcctgtgtggatgattttgactctgacgccttcgacctcaattttttgcaaagctgcggccagcgcttcaacagagccttgaacatcggcttttacgacgaggttaatttctttgacatcgccttgtttaatctgttcaaacaagtcatcaaggctgagcttcgctttatcgctgcgctgttcttcaagctgtttggtagcgcgcgcttcgccgacggaacgggctgttttttcgtctttgaacacaaggaactgatcccctgcgttcggaacttcgttcaacccggtgatctcaacaggagttgacggtcccgccgatttcacgcgtctgccgacatcattgaccatcgcacgaacgcgtccgaaagtgttcccgacgacgatcggatctccgacgtgaagcgttccgttttgaacgagcaacgttgcgacagaacctttacctttatcaagctcggcttcgatgaccgttccttttgccctgcggttcggatttgctttgagctcctcgacttcgctgacgagcaggatcatttcgatcagctcatcgattccctctcctgaaagtgcggaaagaggaacaaaaatcgtctcgcctccccatgcttcaggaacaagaccgtgttcagtcagctcctgcatcacgcggtcagggtttgccgtcggtttgtcgattttgttgacagcgacgatgatcggcacttcagccgctttcgcatggttgatcgcttcaaccgtctgcggcatgaccccgtcatctgcagctacgacgagaatcgtaatgtccgtaacttccgcaccgcgtgcgcgcatcgttgtaaacgcggcgtggcccggagtgtcgaggaaggtaatcttcttgccgttttcctcgatctgataagcgccgatatgctgagtgatgcctccggcttcgccttcaacgaccttcgtttttctgatgctgtcgagaagcgttgtttttccgtggtcgacgtgacccatgatcgttacgacaggaggacggatttcgaggtcttcttcgttatccggctcttcgtatttttcgaattcggtttcttcatggacgatcacttcttcgacttcgacgccgtattctgaagcgatcagctcaacggtatctttgtcaagatcttggttgatcgtcgccatgatgccgagaagcattaattttttaatgatttctgacggttcttttccgagctcttcggcaagcgcgccgaccgacattgagttggtaaattcgattttttcaggcagttcttttttcggcttgaactgcttctcctgaggagattgatgatttttaccgcgtttgttctttttgttgttgttgtttttcttcttgtttttattgttaaattgagtattctgcacgttattcttctttccgtctcgatttttgtttggcttacttccggcattcagttttgcggcttcttgctgcggcttttgtccgcctgtaccggcatcctttttatttcccgcaggtttagcgctcttcttgaatttttgatcgagctgtttgatcgcattttcttcgatcatcgccatatggttattgacttcgatattcatatctttcaatgccgcgataatatccttacttgaaacatttatggcttttgcatattcataaactctcattttagccattcgttcacccccaaaaaaaattaatcgagctttcggagcaacgtattcgcaaaaccttgatcagtgacagcaacaaccacacgggattctttgccgattgaacggcccagaagcacacgatcaccgacttttttcaccggtacatcgtagtgcctgcatttgtcggttacttttttctccgtgttagccgatgcgtcgtctgcaagcaaaacaagctttgcgcgcgaatgcctgatttctttcacaaccaggtcttctccggacacgacctttcgagctcgattcgccagacccagcaaggaaaaccattctgattccgacatttatctgttctccttttccgccagttccagcagttcatcaaaaatctgatcatcaatctgtgcttgaagctgatttgctaagctgtttctcttttttgcagttaaaatgacgtctttatcaagtgtaaggtaggctccccggccgttcttcttgccggtcgggtcaacggaaacttcgccttccttcgaacggacgacgcggatgagctcttttttaggcttcatttcccctgttacgacgcattttctaagcgggatcttctttcggcttttcaccaaaggtcacctcttattcatccgattctggagtttcgctttccaagaaaagctcttccggctcctcttcttcaagctcccttggataaattccaagctctcttgcatctgtttcgcttttaatatcgatcttccagcttgtcagcttggctgccaggcgggcgttttgacctctttttccgatggcgagcgacagctgatagtcaggaacgacaaccgttgtcgctttatcctcttcattgacgatgacgtcgagcacttttgaagggctcagcgcattggcgacaaattcaaccgggtcgtttgaccagtgaacaatatcaattttctcgcctttcaattcattgacgatcgcctgaacgcgctgacccttcggtccgacgcaggcgccgacgggatcgatgtcgggattatccgtgcggacggaaatcttcgagcggtctcccgcttctctcgccacggatttgagctcgaccgttccatcgtaaatttccggcacttcgatttcaaagagacgctttaataaacctggatgagttcttgaaacgtaaatctgcggacccttcgtcgttttttcgacttttgtaatgaacaccttgatccggtcatgaggcttgtagacttcattcggcatctgttctgcaaccgggagaagcgcctcgatttttcctaaagagacatagatgaacttattgtcgatccgctggacgatgcctgtcatgatatcttcctcgcggtcgatgaattcagaatagatgacgccgcgctccgcttcgcggacgcgctgggtcacgacctgctttgccgtctgggcagcgatgcggccgaaatctttcggcgtcacttcgatttccacgacatctccgacaatgtagttcggattgatgtttacggcatcttcaatcgagatttcaaggcgcggatcatacacttcatccacgacatctttgcgggcgaaaacgcggattgaaccggtgtcgcggtttaaatctaccctgacgttctgcgcctggttgaagttccgcttataagcggaaatgagcgcagcttcaattgcttcaataataatgtccttactgattcccttttctttttcaagaacagtcagggcatctaacaactcactactcatgtttatggtttcccccttaaacagtcaaaaattaattgaacgaaacagccagcctcgctttggctactttgtcatatggaatattgatcgttttccggcgcgttttgatcatcaccgtgacctccacgttttcaccgtcaaatgcggaaagctcgccttcaaactctttattgccttcaataggttcgtacgttttaatatatacgttttttccgagcgccttcatgaaatcggcttctttctttaaaggcctctcagctcccggggacgatacttcaagaaaatagttttgcttgatcggatcagcctcatcgagcttttcactaagagcttcgctaaccttggcacattcctcgatgtctacgccgtcatctgaatcaataaacacgcgaagaaaccagctctggccttccttgacaaattcgatgtcaacgagctcaagctgaagattgtctagtataggctggaccatttcgctgacggtatcgatcactttgttactcatacttttcctccttgtgcaggctcccattcatcagctccctcgtaaaaaccctgcttcaaaagcaggggattttagaaaaaacgatgaacatgtcgagacaaaattgcctgttcaatacaaaagagcgggtttccccactcttcgcctcggctatcgttagcatttccaataaaactataccataaccatatttttattgcaaatcatgacagcgtttagtctgaagcatttcggaagcggctgatttttcattcatccgctccgcgtgctctgaaatgacagaagcggcagagctcggataaacgatccgaaaaccgtcatagtccggataaagggtcccgtcatcctgaatgccggtcaaaatccaaaattggctgcccgcaccgctctgcttttctatgagttcaagccaggttctgtagacgtagtcccttctggacttatcctgatagccgtactcttctaaaacgaccggcttgccgatttcttttccatcgcaaatatggtctgtgatccactgattcccccactcggccgttttgccccaatgatccggatagaggtgatatgtgccgtaatcaatatgcttcagagcggtcagccttttccaatccacaccctctccgccgttgtaatgccaatcagggtgcccttctatatgataaaatccttcatctccaaccgctacaagatggttctgatcaatggatttaataaattcgctcatctcatccgcccattcgacaagtgtatttccggtcctgtcagactggaccctcggttcattggcaagctcccacgccataatcgcgggatcatctttatatttgacgccattatatgtgttgactcggttcagcatataggatacataatttttatacgcctctttaatgtccggatgagtataaaaggcgtcatgtccatccgcctgaaaccacctgacatattgattcattccgccgaaatcatcccagttgttcacaaaagggatgactagttttatccctgtctgccccgctttataaatggcatagtcaagctttgaaaagcctgattcatcatatatgcccggccttggctgcatgactgtattttcctgcggctggccgtcaagaaatccccagatgcggatcactttcaaattcatcgctttcatatcttcgaacacatcatcgaccatttttttagatttataattaaaataatagttattcgtcccggcaaaataaaattctttcccatttaaagtgaacgatgttccggctgtctcaacaaaaggagacgcggctagtgcaggccggggattgccaaactgaatggcggaaagtgcaagcaaaaacggcatcagcactgtcaataaaccctttttcgtcatcattatttttccctgctttcataaagaggatgcatggacggcgtcattgagaggatagccggccgttcaaggcgtgattttcaccttcacgaccgcctccacgcctttcggccacagttcaaatgtaaaggtggaatcgcttttcaaatactttaaaacccgctctttcaaatacaaatccccgtctttttcgtaaaaatcttcgtcatagttcaagtagggcgtccatgaccatacttcttcaagaaccggccttcctgtagaatcgacgactcctttaaccgtggccagcttcgttccgttcagtgacgccgggattttgagatcaccgctgattgccgattgactgatggtgaattcgcttttttcaagcttcgggtcatcataaagaatgatatccataacctggctggctcctttatgaaacgtaaaagtgagctgcgcttttaccccaggctgccccgccccgttcagcagctttgccaagcaggatgccttaatagagaccgtttttccggcattgtcaactgtataatcactgccttcctttaatggttcagatttctgataaatgccagtcagcacattgccgttcagctgaatgtccaccgtctgatcgctgatgctttgaccttttttgataaaaagatctgccggtttgatgatcgcattgggaacgccgcgtcccgcctgaatgacaatctctttaacaacaggatcacgccactgtctctcagcccggtcaaactggtcattcccgttgtcccaccacatcgggaccatttgatatttgtgggcaaggcggacaaacgtatcatgatagagccattttgaatgcttttcattggcgccgagggtaccgtattcaccgatgataaccgggtatccttcccttacaaatttttcataaaccggtttgatatcctcctccatctcggagatttcggctgccgatccccaagtcgtccggccccaccagtttgatacgtaatcccaaggagaatagtagtgatatgtgaggacaatccggtcatcatcaggcggttcaaatgaatgaagcaattcatctttgttatcttcaagccccccgacgattacgagccgctggccgtttttgccgccggtcgaacggatgatgttcagcatctctcggttaagcagattcatttgatatgcgctcattccggtcggctcattgacaatttcaaacaggaggcgttcacttttgtttttgaagcgctcggcaatctgcttccagactttccccagcttatctaatgtctcctgctggctgtttcccatccggctgatccatagccaagaatcgtggtgaatatttaacacgacgtaaaactctctttccaaagcccaatctgtcacttcttctacccggttcatccaatcggtatcgatcggatactctggagcgctgccgatgtgggaatcccatgtcaccggaatccggacgcttttaaaccccgcatcgcgaatatcatcaaaagtatgctcgcgaaccggcggattgttccaagagccttctgtcggaacagcatccagcgtgttgccaaggttccatccagggctcatgttttccaaaagatcagccggggtgatgatgctctgcttttcttgctttgctggcccgcttgttcccgaagctttcggaactgcggataaaagaacggttcccatgatcaaaacgaacagaatgatcgactttaaacataaggctaaccatttttctctcaaacttttgatctcctttttagataatcgtgtaaaacactcgctaaaatcctaaatcctgcctttaaaaaagaaggcggctgaacgccgcctttgcccaaacggccaagcgcatctaatattctcctattgattgttatgcatttccgattaaacggtcatactcagcataagctgtcgccatatcgacctgagaccagaaacggtgatatacaaaggtcggcagtccgttttcccatttgcccgtattcggattccacgaggtctgatatttgttttccaaataaggccacatcggatcatttttaattttcggccggagctccgcatgactgatatagacgccgttaccgccttttgccggatcagacggcacagtgttggggccagggatggtattgccctgcccgtttctgccgctccagccattcggaaagtagatttccttcgtaaagtagcggatataatcttcatgttcttcctctgctgcgataccgattccgtcatttttactccatgctgcatcaagcagttcttttgccagatttttggctttgtttccaagagcggtaaagccgccggtttcggcttttgttccggccgcaaagaagacgagcgttttaatatagctgccgagaacgccgacatcttgagaaggattcttcgtcgtgacatgcagtcccggatttccggtaaatgaatcaaatcccttccacggatcaggctggccgctccattcaaggtttgccggaatccaaaactcgcctgggtcggattgtacggcgatctgcgggttttggccgccaaggacgcgttctcccgcatcatttaaataatagccttcttcgtcagtaaccggccgttcgcccacaaacacataatcaagtgaatatgcgatccatttttcaatcacatgctttgccatgtggaagttttcagacgatttgtcacctttctctgcgaaaatataatacagttccgccaccctttccagcggccagacttgcatcccgaaccaattgttagaagggggatcgtgatatacaggcgcttctgtgtaggccatttcgtaaaatgtgctgacattctgcggatatgcgctgtagttgccgttccagctgttcgtggcgccgccggcaacggctccttctgaagaaagcagccatgtgtaaagttctagctgccttttcagcgccttttcccaatcgcttcgcgctgtggatgaatttggaatcaatccgccttcagccgttgacagtgcataagaggcaacagggttttgataaccttgatgcacatggctcgcaccgatccgccacgcccagtttgcatactgtcccaatccgcctccccaagcggtgtaccacgccattaaataatgacatgcattttttccagcaccgcgggaaggcgagccgtcagcggcacttccaatctcttgaaagtatttgtcatacatgccgtaacggagaaagtcccccatttttttagctttttctaaataattagtattgctgtagccccattgcctggcccagaacatcgcctgaacggcgcgcgcatctgcatccgttgcattggtgtagcgccattgcggtgctggagcctgattttcttttgtaaaaaggctcatgaaaccttcattcggttttccgaacgtctgattatcctgagacggatgcggaaccgtttcccaaacggattcctgttcgccccgctggtaagtgttcacataaacggcagtgtgcgaagggttcagaagatttccgaagccataccagttgtcaacatctaacagccaatgcattaaatacgtttcgttgcttccatatgtcgctttaagctcggcatcgagcgggtcatttcctgccggatactgtccggtcagcgctgaagggtacagatctgggtaggggtgttctgcagcataagtggctggacttgaggggttgtagtagttcatggtcggctgttcttcgtttccgtctccttcattgaccgggataatatatttctccatattgtcccaggcggcttctagctttgaccagtcctgtgtgtaccggccatacatcgcttcaagccacagccaatagctgtacgcttcagatgtcgtcatatgaccgtagtcgggcgcctcacatatgagcgtttcaaccgagtgatagggaattccttcgggtgagaaataaccgttgttcggatttttaatttgctcatacagctgcataaaacgtgttttattatccatgatgttcctcctcttgaggttcaatatctagtaaccgggctcatgtccgaaaacgagccgtccatcatcataaacaggaatataccgcgtcttcagaagcgcatgtgacagaccctgataagagtggtcattttccgggttccaaaaagacgttccgtctggtgccgaaaggcggaactgcacttcttttttatgggcggattgaccgcctggataaatcaaaaccccgctgaagctgacttctgtatagtaaatgtgctttgaagcgtcatgcggcttcagctctgataccgaggccccttcgttatagccggctgtgacttttatatcttcggcggaatatcccgcttctacagcttccgtcaagtcaacgtagtagcggaaagacaattgatcggttttctttgccggccatcccgaacggttattgagctgcgcccggatttcagtatagctgtttccggagctgttgattgatgcctctgcaaaatattcgtcctcaggtgtttccttctccggaaaatcaggcagcggaacatggcctttcccgaacagctgaaacattttcgctacgttgccggtaaaagcggcattataatcgatcgcaacttcgtttgacgcataatctgttatgtcatctcggtacgaatcgtcccttcccggaccgccgactaatgcgccgtatagggtatggcgatggttttcaggcacattcatctgattggcccatgaaccgtgtgctgtacggtgatgcggatgtttcggcggatttttaccgtatccaacgacaaagcttcgctgctgcggattatctcctagcatatactccgtttgccgaacagcaaaatcccgatatcttttcgctttttctgtatccacccaatcggaataaacgaaagcgagaaaagcggcattcgaagcgtatcgcaatgatccccactgctcaagccaggccaaaccgcccggcgtatacgtgatccgttctatgcttccattatgactgtagcctgtcgaccaataatcaagattgcgttcgacagatttgacaaaacgggaatcgtttgtcagacgagcgagcagcagctgtgctccgtaagtgacgtcatcccaggaaagcgtccagcggtaaggccagtttgcgggatcgccccaatctgagaccgaagcaagggctttatccaaatattgttgttcttctgttgccaagtagagccagacagctccccatgtcagttcatctttatacccgctccacgaattataatattgctgtgcgtctgtaatgcagtctgaatatttgccgcggtagcggtcggcaaaatcatacaattgcttggcatgagccagtaatttttcagagtaagaagaatctgtcggcttgaaaataattgatgctgatgctagcgctgcggctgtaccaccagcaaggtctgaccccggacagccggcatcgatcttataggcagggcgcttcatcggcattacttcggccggcccccaccatgcgtggtctagagcgccatttccgacttggccccacaattcataaggagccgtatgggctttaagaaagtagtctgtcgcccatttaatattgtccagcgccgcatcaagctgacccgattctttgtaggcatctcggtactcatagaccgaccatgacaggattgcggcagaataagccatcggcagaccgaacttcacgtggtcgccggcatcataccaccctcccgttaaatcgaggccaacgtcttttccgtcctcaagcccggagtctcctctccaattcagccggctgttttccggaagtcttcccgagcgctgtgcttcataaaataacaaagacttttgcagcagttcagcataattatgaggatattcttcagcagaagctgcacgggtcttttctgaaaacgacgctatgctcatagagaagatcactaaaagtgccaaacaaagcgctttcatttttaaaaatactttctgtttcacgtactgcttcctccccatcatgttcgttaagatcaagcaactccatctgtctacaacatgctcacctccttttagatttgccggcgaacaaaacaaggccaaagttgaaaaaccgaagatattgattgcacattaaatcagcacacgactgcaagcgaggaatttgataagtaacttagtttatttgttcaataaactaagttatgagagtagaaatctaatagacagcacattccaaacgaagtgttatattttggaaattctaacattgatgtttatttattgtcaacagatctgacagccctttatttttttgtgatcatttctcccctggcatttgtcacccaattccgaaaaaacgctctttatgccgtaaaacagataaaaaaactgcctgctttaagcaggcagtttctagaataatgacagctggttctgatctggaagcgactcgagacagccgtggcgctccaagtattccatgatcgtttttgacacctttcctcttttttgcaaatcttctttggaaagaaattcgccttcttccctcgctttgacaatattcaaggcggcgtttgttccaagccccggtattgaattaaacggcggaatcaagctgtttccatcaatgatgaattctgaagcgctcgatctgtataaatcgactttttggaaagagaagcccctttcgcacatttcaagcgccagctcaagcaccgtgagcaaacttttctcttttggagaagcgtcaaggcctttagagttgatatcatccatgacggctctgatcgctgtcgatcctttgatcatcgtttcgatgtcaaagtcgtcggcccgcacggtgaagtatgctgcgtagtagagcagcggatgatggactttaaaataagcgatcctgaccgccatcaaaacatatgccgcagcgtgggctttcgggaacatgtatttgatttttttgcaggaatcgatataccagtccggaacattattattcttcatttcttcttcccactcaggcgtcagtccctttcctttacggacaaactccataatcttaaaggcgagggatggctcaagcccctggtagattaagtacaccataatgtcatcacggcagccgatcacttcgctcagttcacaaatattgttgtgaatcagctcctgcgcgttgccgagccatacgtccgtaccgtgtgacaggccggaaatctgtacgagctcggaaaatgtcgtcggcttggtgtcctcaagcatctgtctgacaaagcgggttccgaattcagggatgccgagtgtaccggttttacagccgatctgttcctcggttacccctaaagactctgtcccttggaaaattttcatcacttcaggatcatcggtcggaatcgttttcggatcaatcccgctaagatcctggagcatacggatgaccgtcggatcatcgtgtccgagaatatcaagcttcagaaggttgtcatggatggaatggaagtcaaaatgcgtcgtcttccattcggaatctgtggcatccgccggaaactggattggtgaaaagtcgtaaatatccatataatccggcacaacgataattccgcccgggtgctgccctgtagtccgcttgacgcctgtacagccttggacaagtcggtcgatttccgccccgcgcatatgcaaattgttgtcgtttgcataccctttgacatacccgtaagccgttttttcggcgactgttccgatcgttcccgcacggtagacgttatcctctccgaacaggactttcgtatagttgtgggcatgcggctggtattcgcccgagaagttcaagtcgatatcaggaaccttgtcccctttaaaccccaggaacgtctcaaacggaatgtcgtggccgtcttttctgtaggccgctccgcacttcggacagtctttgtcaggcaaatcaaatcccgaaccgaccgatccgtcgttgaaaaactcggaatggcggcaatccggacagacgtaatgcggcggcagcgggttgacctcggtaatttccgtcaatgttgcgacaagggaagaaccgaccgatcccctcgaaccgacgagatagccgtcatcaagggagcgttttacaagcttatgagagatcagatagatgacggcgaatccgtggccgattatgcttttcagctctttttcgatccgttttccgacgatttcgggcaggtcctcgccgtaaatgcttcttgctttctcatagctcatgcggcggatttcgtcatctgcgccttcgatcttcggtgtgtaaagatcgtctttgatcggcttgatttcttcgattcgctcgctgatcatgcgggtgttcttgacaacgatttctttcgctttttcctcacccaaaaatgaaaaggcctcaagcatttcatccgtcgaacggaaatgaacgttcggcagctcgtgcctgttgagcggatttgcgccgccttgcgaggaaactagaatcttccggtaaattttgtcctcagggttcagataatggacatttccagttgctactactgggatattcagcttctcgccgagctttgtgatgttggcgatgatttcttttaacgctttttcatccctgacgagttcgagctgaagcaggtgccggtagacttcaggcggcatgacttcaaggtagtcataaaatgaagcgatgtcttcaacttcttccggcgatttctgcatcatgccttcaaatacttcgcctttgtcgcacgccgaaccgattaaaagcccttctctgtacttttcaagctgtgaccttgggatcctcggcaccctgtaaaaataatggatatgcgacagcgaaacaagtttgaaaaggtttttcaagcctgtctcattaaccgccaaaagtgtcgcgtgatatggccttgaacgctgataggcattggactgccccatattttcattcagctgatcgtggtacaggatatttttttcggccgcatctttcagcattttcacaaggagataacccgtcgcttcggtatcataaatcgccctgtgatgctgggtgagctcgatgtcaaactttttacaaagcgtattcagcctgtggtttttgaattccggataaagaaaacggcccagctcaagcgtgtcaatgaccgggttctgcactttctccgaattcagcaggcgcttataggcgacattgatgaagccgatgtcaaagcttgcattgtgagcgacaagcgtgtgatcaccgacccattctttaaaatcgcggatgacctcttcgacttcgggcgcatctttcagcatatcatcggtaatccccgtcagctcgatgatcgtagccgataaaggtcgatgcgggttggcaaacctttcaaagcgttcgatgatttccccgccttttactttaacggcggccagctcgatgattgtatcatagacggcagacagccccgtcgtctcgacgtcgaacacgacatatgtttcctcttcaagcagacggtgcacgggattgtaggcaatcggcacgccgtcgtcgacgaggttggcttcaagtccgtagatcattttcacgccatgctttttgcttgccgcgaatgcatccggaaacgattggactacggcatggtcagtgagcgcgatagccgggtgcccccattttttcgcctgttcgacaagcttgccgatgcttgatacggcatccatctggctcattggtgaatggaggtggagctcgactcgtttttcgtcctctggcgctgtatcctcacgggttttcgctttgatttcattgacatcgttggcgatcatcaccaaatcgcggacgaatgtatcgttttgtatgcttcctctcgccttgacccacatcccttttttcagggacttcatcaatacagcgtcttctttttcgcgggcgaacattttgacgagaatgctgtttgtatagtcggttattttaaagatgcaaagcgttctgccgcttttcagctctcttgtttcagcgtcgaatacatagccttgcaccgtaattctccgctcttcatccatgatgctgtcaagcgttctgatttcttcagagtctttaatctggtagccgatctgaagagggcctgccggcgcttcatcgtcttgtgcttccttatcctgcttctccatttcgattaaagcctgaagggccctctcttgatcttcggccattttttgctctctgaatttctgaatctcttgatctgatacaaaaatttctgtgtccagctggagctcaggaaagccgaatgtgcggtagcttgactggatgagcgagctgtatttcttttttaaagcggacgcttctgtatctgttttcgttttaagcaggattttgtttcccgtaagcttgggcttttggtcgttcaaaagcgccaagatcggcggagaaataccatcgagttcctgaatgcagcgcgtccagtaatcctgaacaagctgctcgtcaatcgaagggttttccgcctcgatggaacaggtgacctgggcgatatgggaaaaggtgcgggtcagctggctgtgaaaccgttcgaagatttgataaggcagcacatttctcaatttaaagtgaaagtgccatgtcttcttgtttttatgaacggtcagttttatgatttgtccgccttcaaggtggcggatcatcgtatcttccgttacattcagctgctgcagaagaatttgaaactgtcttctgttgacagaaagctggtcttccaagacagattcctccctaaaagaaaatcataattgaaggtaccttgggacgattcccgaggtaccttcctttactctagtttaccatgttttaagagtgagaagataagctcttgacttgtttttcgataaagtcaaacagctcatcagcagcgatttcaaaggattctccggttttgcggatcttcacttcgacaacgccttcgtcagctctttttccgaccgtgatgcggatcggcagaccgatcaaatcggaatctgcaaatttaacgccggcccgttcggcacggtcatcaaacagtacgtcatagccgttcgctttaaattcttcatacagcttttcggcaagctgaacttgcgcgtcatttttcatattaagcgcgaggatatgcaggtcatacggcgtcacttccagcggccagatcaagcctttatcgtcatgatgctgctcaacgatggccgaaagcgtccgggaaatcccgattccatagcagcccatcagcatcggctgagcgcgtccgttttcatcaaggtatgtggcgtccatcgcttcagaatagcgggtgccgagcttaaagacttgtccgacttcgattccttttgcaaaacggatcgttccttttccatccggtgaagggtctccttcctggataaagcggagatcggcgaatgtcacattgtgcgcatcccggctgatattcacgttttgataatggtaatctgttttattcgctccagctgctgcgtttgccatcgccttcacagcaaagtctgcaaagatttcgatttcgcggtcgagccccaccggtccgacaaaaccggtttcagtgcctgttatctctgcaacctcttcggcgctcgcgaattcgattatttctgcttgaagcaggtttttcaccttaacatcattgacttcgtgatcccctctcgtcaagacgaggacaaaacgtccgtctgctttcatcagcattgatttaatgcagtctgacggggatatgccaagaaatgcggcaacctcttcgatcgttttgaccgaaggtgtgtggacttcctgcagctctttcatttctgcctgctcgccggcatctgtttccttcacttcagccatttcaatgttggcggcgtatgaagactgatcagaatacgcaattgtatcctcaccgacatcggacaatgccataaattcatgggtatcctttccgcccatcgcgcctgagtctgcaatgaccggtctgaaattcaggccgcagcgcgtaaacacattcgtatacgcctgatacatatcattgtacgtttcatcaaggctttcggcggaggaatggaaggaatacgcatccttcatgatgaattcccggcctctcaacagaccgaagcgcgggcgcttttcatcgcggaacttcgattggatctggtaaagggtcagcggaaggcgcttgtacgatttcacttcatctctgacgatgcttgtgatgacctcttcgtgtgttgcgcctagggcaaattcacggccgtggcggtctttcagcctcatgagctcaggaccgtacgtataccatcttcccgattcctgccaagtttccgcctgctggagcgccggcatcagcatttcgacggcattgattttctccatttcttcgcggacaatgctctggattttatgaatgactttattggcaagaggcatatagctgtatacaccgcttgtgttttgtctgataaaccctgctctgagaagaagctgatggcttttcgcttcagcatcagccggcacttcgcggagcgtaggaattaaagtcctgctctgtctcattcattcgcacctcatttgtttcagttggttacttttttgagtcgggaacggtgtccctaaaaaagagccttttaaaaggcttggctgcacttaaaaaaggcgattggttttacagaaataagcgctggatatcgttccatgtgacgacaagcattaggagcatcaaaaatgcgacgccgataaagacgacaaacgcttctttttcgcggttgatcggcttcccgcggatcgcttcaataaacaggaacaacagtcttccgccgtccagcgcagggattggcagaaggttgacgatcccgaggttgatgcttaaaaatgcggccagcttcagcaggttgataacgcctgtcctggccacttggtctgtcatgtcataaatgccgacaggaccggccagcatgtcgattgagaattgtcctgtgacgagctttccgagattggtgacgatgctctgggccactgtcgccgtttcggtcgcaccgtaggaaatcgatgtcagaacgcctgttttcacaggattgtaagcgccgaatctgccgacggtttcatcccctgccttgacagcttcaggtgttacgtatttcgtcagcttgacattgtcgcgcatcaaaacgattttcagttctttttcagggtgttctctgaccgtgttgacaatatccgtccacgacctcatgttctccccgttgatcgtttgaatgcggtctccctcctggaggcctgcttccgccgcccgtccgttgtctatcaacttgccgagcaccggctcgtcagacggcactccctgcatcagtccgagcatcacgagtatgacataagccaaaataaagttcatgatcggtccggcagcaatcgctttgatgcgctgccaaaccgttttcgaatgaaattggcggttgtaaggagcgatctggacttcttccccgtctacgatgaaaaaggacgtttcactgacagaaaatgaagagagatgatcttcattgccgtgctcatagcccgtaatcctcatctggtgctccaggtcggcctgctccacttcaatgaccaatgcgtcgggatacttttctttttggttgataatgatcttttcgaccttgttttcgctgtcgaacaacagcccgaccgtataaccgggcttcacttcaatcatctcaggatcttcgccggccattctgacaaagccgccgatcggaagaagcctgatcgtataaacggtctcatttttcttaaacgaaaagattttcggaccgaagccgatagcaaactcccggcacagtattccggctctttgagcaaggatgagatgaccaagctcatggaaaaatacgagcgttccaaaaataagaataaacgcgatcacagtattcacgaacataccaccttatgtgagtaatgtttggacaaactttctggcgtctttgtccacttcacggatctcttgaaggctcggctttgcgatcacctgatggcgttccaaagccttttcaatgatgtcttctattccgagaaaggaaatcctgcccgaaagaaatgccgcaacggcttcctcgttggccgcgtttaaaacagtcggcattgtaccgcctattttacctgattcataagcgaattgtaagcagcggaacctttcaaaatcagcttgggcaaaattcagctgtccgacttcccagagatcgagggattttgcttcattaaacggcaggcgttccggatggctgagcgcatattgaatcggcactctcatatcaggtgtgccaagctgggcgatgacgctgcggtcgtggaattcaaccattgaatgaataatgctttctttgtgaaggaggacatcgatctggtcatagggcagatcaaacagccagtgggcttcaataacctcgagtcctttattcatcattgtagccgaatcgatcgtgatttttgcacccatcgaccaatttggatgattgagggcttcttccactgtgacgccttcaagttcccgccttgttctgtccctgaagctgccgcctgaagccgtgacgatcagccgtttgatatgcttcggattttccccctgaagggcctggaaaatcgcggaatgttcgctgtcgacgggcaggagcgggacatcgtatttttgggcgtgttctttcactatatgaccggctgtcacgagagtttccttatttgcaagcgcaattgtttttttatgctccatcgcctttaaagtcggaagaagaccgacgctgccgacgagagcattgacgacgatatccgcttccgggataacggccgcttcgattaaagcttcctccccgatccctgttttaaaggtgtaggagaaagaatgctgttttaatgtttcatatgtatgctcatccccgacgcctacatacttcggtttaaaggtttcaatgatttctgccgctttttcggcgtttttgccgaaagtcatggcggtcagccgaaacttatcgtcatgcgctttgatgacatcaagcgtctgttctcctatggagcctgtcgctcccaatagacatatgttcttcaaaattgccgcacctctgtttctttctagctatcagtacccttttctatcatagcccgaacggctgaaaaagaacaagcaggaagtacagaaccggcatgacaaataaaaagctgtcaaagcggtccagcattccgccgtgtcccgggaggatccggcccgagtctttcacctggtaatgccttttgaacgcagactcggccaaatcgccgatctgaccgacgattgacaaaagcacggtaatgatcagcacaaacagataagcgtgcggaaaacctgtggcggcctgataaatcgcggaaaaaacgaccgctgtcaaaattccgccccaaaagccttctaccgttttgttagggctgatttcaggccagagcttccgctttccaaacgcctttccgataaaataagcgccggaatctgttgaccagacgacgccgatcgcaaaaaagacatagctgagtccgatgtttctgatttcaataaagtaataaaacccgaatccgatataaactgctgccagcgccacgaatgccgcttcgtcaaaagtaaacgagtttttgctgagcaccgtatatgccaaaagcaaaaggaccgccaaaaagacgacctcccctttggttatacccagcccagcgtcttccgcgtattggcttggacacagcaaaaccgccaacagcagcatgctgatgatacccggagcgctgatcagcttcaggcctttcattcttaaaagttcaaatagagcaagtatacctattgcataaactagcagggcgaacggcagctcgccgaaaatcacgagcggcagaaaaaccgctgccgcgatcacacccgtcaatattctctgtttcatctgcaccatcctctaaattccgccaaaccttctcccgcgacgctgatattctccgatagcctgaagcaagtgaacgtctttaaaatcaggccacaatacatcggtaaataaaaattcgctgtaggcaagctgccaaagcatgaagttgctcagcctgatctcgccgcttgtgcgaatcagcaaatcagggtcctgcaaagtttctgtcattaaataatcggaaaatagcttttcgtcgatttcctcggtattcaatgtgccttttttggcttcttcggcaattttctttgcggctctgacgatttctgcacgtcccccgtaattcaatgcaaaattaagaataagtccatcattgttctccgtatcacggatggctttttcaaccgcgcggatcgtgtggggcggcagtccttccctatcgcctgtcatgcggacccggacattttcttcgaccagctccgggagatacgttcccagaaactcttcaggcagcttcatcagaaagtcaacctcaagctttggacgcttccaattttccgtcgaaaaggcatacagcgtcaacgctttgacaccgagctcattggcaagctttgtcgtctgtctgaccactttcatgccttcgtgatgacccgcgatgcggggcatcgcccgcttctttgcccagcggccgtttccgtccataataatggcgatatgttcaggaatttctccttttaaaatattttcttttgtgtaacattccatgttggaagcagccgaatgctgattcttccaatttttgagtatattgagcatgagagtcctccatcacccaaaaggttgctttcctgttatatcgttctagataacaacagtattaacaaaaaaaccccctgtaaacatgagagggtcttttcactattatctattgtacagagtttttcattaaacttccatgatttctttctctttatcttttgtgatctcatcaatttttgacacatattcatctgtcagcttttgtacgtcttccgttgaagagcgcaattcatcctcagtcatttcaccatttttctctagttttttcagatcgtcatttgcatcacggcggatgttgcggaccgcgactttggcatcttccgaatattttttcacgagtttggcaagctcttttctgcgctcctcagttagaggagggatcgtgatccggatgatattgccgtcgtttgacggagttacaccgaggtcggctttttgaatcgctttttcgatatcgccgagcgccgttttgtcatatggtgtgatgacgagcatgcgcgcttctggaactgtaatggacgcaatctggtttaaaggcgtctgcgctccgtaatactcaactgccactttgtccagcaatgacggatttgcacgtcctgcgcggacagtggccaattcgcgctgataagcgcttatcgctttttgcatccgttcttttgtttcattcatcacttgagttgacacgttatttcccccttacgattgtaccgatttgttcgcctaaaacggctcttttaatatttccttcttccataatagaaaagacgatcagcgggatgtcgttatccatgcaaagtgaagaagcggttgaatccatgacagccaaaccgtctttcaacacatcgagataagacaatttttcatattttacggctgtttcgtcagttctaggatcggcattgtatacaccgtcgacattatttttggccattaagatgacgtcggcttcgatttcagccgctctgagcgctgctgtcgtatccgttgagaagtatggattgcctgtaccggcagcgaagataacgacgcgcttcttttcaagatggcgaatcgcttttcttcttatgtatggctcagcgacctgcctcatttcgatggatgtctgaactcttgactgaatcccgagcgtttcaaggctgtcttgcagcgcaagggaattcataaccgttgcaagcattcccatgtagtccgctgttgcgcggtccattccgagatcgctgcccgtttttccgcgccacaggttgccgccgccgacgacgaccgccacttcaacatcaagctcggcgatttctttcacctgtttggcgatggactggatcacggtcgggttgatgccgtttccctgttcacccgcaagggcttctccgctaagctttaatacgatacgattatactttggtttttccataataacctccaagtgcatgcttgccgttatttattatgcaagagaaaaaaaggtttgtaaactgttttaaaaatagggacacaaattgtgtcccctattttccttgaaaagatcctgccgtgtgttttatggcaagcggcttttcaatcttattttttcacttggttcataacttcttcagcaaagttttcttggcgtttttcgataccttctccaacttcgtagcggacgaacgtttcaaccgttgcgtttttcgcagcaacgacctgtttcactttttcatccgggtttttaacgaacgcttgatcaagcaggcagatttcttcgaaatatttgttcaggcggccttcaaccatttttgcgacgatgttttcaggcttgccttcttgaagcgcctgctgagtcaagatttcgcgctcgcggttcgcttcttcttctgacacttggtcgcgggaaatgaagcgagggtttacagctgcaacgtgcattgcgatgtctcttgctgtttcttcgtcagttgtgccgttaaggacagtcaatacgccgatttttccgcccatgtgcaggtatgcgccgaatgcagcgtcatcgccttttgtcaggacagcgaagcggcgaagcgtgattttttctccgattttagcaaccgcgcttgtgatgtattcttctacagttgaaccgttagccattttttgacccatagcagcttcaacgctttcaggcttttcagccagaatgtggtcagccaggtcgttcaaaagctccttgaagccttcgtttttcgcaacgaagtccgtttcagagttcacttcaagaataacgcctgtgttgccgtcggttttgatcaaagtcaaaccttcagccgcgatgcggtcagcttttttggcagcctttgcgattcctttttctcttagaagatcgatcgctttatccatgttgccgtcagtttcagttaacgctttcttgcagtccatcatgcctgcgccagttttttcgcgaagctcttttaccatttgtgcagtaattgccatttttgatttcctccttatatatcaaacaaaatatgtaaatgttgatctggtgaaaaaaaaggtgataaaaggcagacccccttatcaccttttgaccaggttaagcagttgttgtttcagttgtttctgcttctttcgcttctgtttcagctgattcttcaccttgttttgcttcaaggatggcatctgccattttagaagtcagcaatttaacagcgcggatggcgtcatcgttcgcagggatgacaacatcgatttcatcaggatcgcagtttgtgtcaacgattccgatgatcggaatgttcagtttgcgcgcttctgcaaccgcgatgcgctctttgcgaggatcgatgatgaacagtgcgtcaggaagctctttcatttctttgattccgccgaggaatttttcaagacgctctaattcttttttcaattgaacgacttcttttttaggaagtacgtcaaatgtgccgttttcctgcattttttcgatatctttaaggcgtttgatacgcttttggatcgtttcaaagtttgttaatgtaccgccaagccagcgttggttgacatagtacattccagaacgttccgcttcttctttaacagagtcttgagcttgctttttcgtaccgacgaaaaggatttttcctccgtcagctgcaaggtttttcgtgaagttgtatgcttcttcaacttttttgactgttttttgaagatcgatgatgtagattccgttacgctccgtgaagatgtaacgcttcatttttgggttccagcggcgcgtttggtggccgaagtgaacaccagcttcaagcaattgcttcatagaaatgactgacatgtgttatttcctcctaatataatggtttttttcctccgcttaggtcatttttatgcaggactgcacgcgagaatcgcacagcaccgcttgcataaatcgttaagcgtgtgtaattaacaccaagaaataatataacataagctttctcgacaatcaagaatcgtttttgagctttccgcgaaattttaagaaaagctcgatttctgttttcccgcttttcagctgtcttgcgatttcctccggagagagccccttttcatataatgcgagagcttcttcttcataggatatggatgcttcctgctccttttgattgagctcatcctcttcctgctccacctcattgatcatcgcttcgatgtgaagcggcagatcgcgcgattcgtccgcttccggaaggacgggggtttgagcgggaatttcaggctgtgtttccggtctttgcggctctttttcggcattcgcccgaatctcttgaacgagtttttcattttcgtcttttaactccatcaaaaaagcggtcaatgtattctcggtttcttccaaaagctgtttttgctctttctccgctgccttgaaagcgctgagcctcgtattcaaaatgatgacgaaataaatcaatataccgtggagcgtgaagctcacaagccataatattgttgacatatttttcactcgctaaccatgaaatttaatcaaaaaaagacttcccgtcggacgcttaaaaaatgctgccggtttcatgccggcagcttacatgctattgtaccactttatccagcagatgcttcaatttcaaaagcgccttggagtgaatctgtgaaatacgggaagtcgacaaattcaaaacctgtccgatttccgtcagcgtcagctcttctttatagaataagctgatcacgagctgctctttttctgatagctcgtttattttttccgcaagctgggagatcagttcgtctttgagcattttttcttcaggcgtgctcgttttgtcgtcccttatcatcacctggacgttctccccgtcttcatggtcgtgaagcttctcatcaattgaaaggaggttcgcaaagaaaccttcattgattgtggtcacgacgtcttgttcgctcattcccagctcagctgcgatttcgctcggcgaaacatttcttaagtaacgctgttcgagcttttcgatcgctgcttccactttcttcgttttttcacgggacgttctcggaagccagtcttctttgcgaagaccgtcgatgatagcgcctctgattctgaaggaagcgtatgtatcaaacttcaaatcccttcccggatcaaatttttcaagggcatcatacaaacccagcatgccaaggctgaccaaatcgtctttatgaacggacttgggcaagccgacggctatccggccgacatgatatgtcacaagcggcatatagcggcggattaaatcatcgcctgcctgaggatctttccattctttccaccgcgaccaaagcatctgatcttcatagttcaaggattgcatctttatccccctatattgcttattaaatcgttgttacaccttgtttaactgtccggatgacaagttcagctgattgcggatcgaactcgatcgtccttccgctgtttccgcctgtatcctcgcttacaatcggaatgtttaagagagatagatgttttttaatcgcaagcacatttcttggcccgactttcatcaaatcatttgtcatcttaaatttaaacatttcggctcctccggccattttcgctttcaaagcgtattttcggcatccggcttcaagcagcatcttgaccgtcgcttcgacggctgtgtccgcgtattttgccacgttgatgtccggcgtcttggataaggaagagtccggaagcatgacgtggacgagaccggccgtctttgcttccaaatcatacagcacgagcccgacgcacgaaccgagacccgatgttctgatcttgtcgggagtgcggacgatttttacatcggcaattcccactctgataatcgatgtttctttttctaagattttcatagcgctgcacccaatgcatgaaagagcttttcaaaagaatcatagtccggcagaaggaacaaatgcgctttaactttccggttgtgctcctcgtcaaaaatggagttgtcgatcacgataacttgatctccgacttggctgagctcgatcagcccttcgctgatgacggctccgaacatatctagcgtcagttctgggacgctcgggtacatttgccggtttgtcaaatcagcgagagcggtcaaataagatcccgccataatgtttccgagttcgtgcagggcagaggctccgatatcgttcggcgtcatgctgtcaatctcgaattccggattgccgacaagctccctgatcagctgctcggcctctgaaaaaggcatgatcacgaacatagaacctggaaaatccccttccatgcgcaaaaagatgcttgcgacaggaagatctgcaccgccgaataggttgacaagctcatcaaacgacatcagcttgacaaacggcacttccatttcgattttcctgttcagcaacagggccagggcggaagcggaatggcccgctccgatattcccgacttcccgcaatatatcaagatgctcttctctaattccgttaaatacgctcatcattggctccttatttcttcacattttcagaagcggcggcaaggctcgacttccggtttaaaacagcttcagagtcaatcagattgagaagtctggacccttgcttgacgatgcctttaatccattgcctgccgtcttttcctaccgtttcgggagccgattcaatttcctcttcctcgactgtgatgacatcgttcgcctcatccaccacccagccgacttcaatgtcctgatgggtgatgatgatgattctcgtttcatcagtaatcgtgtctccaggcgcttcaatccgctttcttaaatcgatgacaggtgtgacaacacctctcaaattaatgacgccgcaaatatacggttccactcccggcacccttgttggctgctgccatttttcaatggacattacttctgatacagagatggcatactctttatgatttactttgaacacaatcattttctcaccggtggtagtctgtgtggtcaagaggatcgctctcctttcgctttctatttaataagggcgttgcagtcgatgatcagggctacttgtccgtctcccaaaatcgtcgcgccggaaatggcaaagacgtttgttaaataatcgccgagtgattttaatacgacttcctgctggccgataaaggagtcgacaacaaatgccgtcagcttgtctccttttttcacgacgatgacgtgaagctgatcaagatcatctgaagaatcctcaacattaaactgttctttcaggtaaaccaccggtacgatatggcccctgaaatcgatcacttcgcggtcgtgcgtttgaagaatatctttcttatcgatgacagccgtttctataatagaagaaatcggaatcgcaaacgtttcattttcaagtttgactaacagcacggaaatgatcgacagtgtaagcggaagctggatggagaaaagcgaaccttcgccttcgctcgatttgatgctgacagaaccgcccaacgattccagcttgcttttgacaacgtctaagccgactccgcgtcctgaaatatccgagatttgatctgcggttgagaatcccggcgcaaaaatgagcgcgtcgatttcatgatcttcgatcgtttcggcttcgcgttcagtaatgacgttgcgctcaagcgctttttcgagcacctttttgcggttgatgccggcgccgtcatcctccacctcgataaagacatggttaccgctgtggtatgctttcaggcggacttgaccggtttcaggtttaccgtttttcaccctgacttcaggcgcctcgatcccgtgatcaaggctgtttctcaagaggtggacaagcgggtcgccgatttcgtctattaccgttctgtcaagctctgtttccgctccgaaaatcgacagctcgatctttttatttaattcttttgtcagctggcggaccatgcgcgggaatcggttgaacaccgtttctaccggaaccattctcatattgaggatgatcgactgcaggtcgcctgaaattctagtcatccgttcgacggtttccgttaattcgctgtgttctagctctttggcgatctgctctaagcgccccctgtcaatgaccagctcttcaaacaggttcattaatgaatcgaggcggtcgatgttgacgcggatcgtcttcgttccgccgcctgccgcaggtttcgccgcgtcttttttgccgtccggctgcttagccggttttttctccgcctctttcggtgcggtttctttttcggatgcggcgggcttcgcttcttcttgtgccgaaaaatcgtttttcagctcggtcacttctattttttcaatttcagatacgccgttgattttgttgaaaatctcttcttttccgtgtttgcttaaaaagcagatgacgaattcggaatcaaaatcctccgattcaaggacttctgtttccggaatcgttttaacgacttcgccgacctcgttcagctgctcaaataccatgtacacccgaacgcccttcaacagacagtcctctttcaatgcaactttgatttcgaaacatttaaagccttgttcctcagcttcggcgatgaccgttcgttgaaattcgtcataggaccatttcgtttcggaagacgccgcttcaggcgcttctgccgctgctgccgcctccttgtttgcccctgtcacatcaagcttggcgcagacttcggaaacatctcttttgccgtcgccgccttcgatgatcgaaaggacgattgcttcaaggtcatcgagcgcttcaaacatgacgtccatccactctgacgtgatggtcatttcttcatttcgaatcgcatccagcacgttttccagactgtgcgttaaatgagccatgtcttcatagcccatcgttgcgctcatccctttcaaggtatgagccgctctgaaaatatcatggacaagctgcaagtctgtcggatttttttcgagttcgagcaatttttcgttacaggtttgcaaatgttctctgctttcttcaataaagacgtctaaatattgattcatatccatatgagtcacgccctctcttttttcatatacgtcataatggctgcggcaatctcatcaacatgcttgatgtcgtttgcaagcccgttgttaatgaccgatttcggcattccgaaaacgacggacgactcggctgcttcggcgatcaccgttccgctcccatgtttcaaaaggccttttacgccttctgttccgtcgcttcccatccccgtcataatgacggcgattttttcaaactcccgaagtgaggccagggattgaaacaagtagtcaacagaaggcttgtggcggctttctgtgtcgcggtcatcgagcgtgatcaccaattcgcccttttcaaggccgaccgccatgttttttcctccgggtgcaatgtaaacccagccgtctttcgctctctcaccgttttcagcctccttcacggttacttctgagaggtggttcagcctgttcgctaatgaggccgtaaagccctttggcatgtgctgaacgataaaaacaggcgccttcaacgttttgggaagcttgggaagcactctttgcagcgccctcggcccccctgtcgatgtaccgatgcagatgagctgttttccagcccgaaagcggactgaatcgctgccgcccacaatcggctgcttcgccgtctcgatggcgggctttgagatcggaacttgccggcctttcagtttcacccgtcctgctgtcaaaaccttctcaatcagcatgtctcttactttatataaatctattgaaatcgaacccgacggcttcgcgacgaaatcgatcgccccaagctccagacattcgatcgtgatatctgctccctgctgcgtcaggctcgataccatgacaaccggaagcggatcgctcgccataatccttttcaacgtttcttttccgttcatcacaggcatttcaatatccaatgtgatcacatccggacggagctccttgattttttggagcgcttcctcgccgtttcttgccgttcctgctacagcaatctcgtgattggatgttaaaaacttggtgatcatgtttctcataaaagcagagtcgtcaacgacaagaacacgaatcataatgtattgcccctcctcaggaatgaagataatttttcgataaaggaccggttttcgcccatttccgttctgccgttatgaagcagcgattcggccagcaggtaaaccgccctgctcggcttggaacgcggactctttatcagaaacggctgctgctccacaacggctcttgagaccaggggatcctcaggaatcggccctgcatatgcaagcttttgctgcaaaaaagcgtttaccgtgttggaaaggcggagaaaagcagaaattccgtctttttgggttgtacagcgattgacaacgactttcagctgaagatcgcgtccggttaatgccaaatgcttgatcgcgctgtatgcgtccatgatggatgtcggctccggcgtggtgacgaccagaatttcatccgctgacaggacgaaaggcagctgatcttttgacagccccgctcccatgtcaaatatgacatagtcgaagcttgtcaaagcccgcgtcaattccttcagaaaaaacgcccagttttccctgttcaattcgaacattgcatccagcccggttccgcccgaaatgtattgaaggcctcgcgggccggctgacaaggcgcgctcaaacggcattttttgctggaggaggtccatcaccgtgtagagcgattgccggccgatcagaatatcaatgttccccataccgacatcaagatcgatcaacagcacgctctttcctttttccagaatggcgagagccgtattcagcgatacattcgacttcccgacgcctccttttccgctcatgacagcgagcgttttcgcttttggatgagcgatagcggcgggcggttcggcaaagcgttgccccatccgccttcgtaagctttctgcctgatccatgttcaacaccccgtaagcagtctgacaaatgctgcgtttgacaagtagcggatatcctccggaacattttgtccgtttgtaatatagccgaggccgattctcgattcggcgagcagattcatgacgcttcccaacgaatcggtctcatccactttcgtgaatatcaactgatcgatcggaatgcttgagaactgcttaatgagctccttcatatcctcgtacttgctcgtcgcggacatgacgagaaacgcctgtatcttacgctcaaacggaatgatttccttcagctccctgacatattgcccgtctttgaaattccggcccgccgtatcaatgaagacgtggtcaaaatcggcgaacttttgctgggcagctttaaactcttctttcgtgtagcacacctcaagcggcgcattcagaagctcggcatatgtcctgagctgttcaaccgctgcaatcctgtacgtatcggtcgtgataaaagcgatttttttctgcttttccagtacagaagaagcggcgagctttgccaatgtcgtcgttttgccgactccggtcgatccgaagagcacgacatattgcgaatgaatcgccacgtcctgttccagattatcgggaagaagatcggccaaagcatctgttaagtgcgccagcgtcttttcatccgtccactcttcgccgtctcttaaagaagtgctgatcaaccggccgagcgctttcgtacggatggccggcgatacccctttctttgccaggagctggtccgcctttttcagcggttcaggcagcacatcaacaggctgctcatgatgccgcatttccagcagttctttcagctctttcacttggcttgccaaatcaagatggtccggctgcgggacaggcgaagggctttgttcccggaaaacgggcttttgacgctcttgcttccttgcgtcggaaaagtcctggtcgacgaccgcgatcacttcaaccccggtttttttcacaaagccgagaaattttctcttttgaatttttttagaattcaagattacggcgtcattcccgagctcctgtataatttgctttgtggcttcctgcatagaaccagctacaaattttttgattttcattgaatatccaccactccgatgctttgaacttctacattggcttccaattcgttataggaaagaaccggcagatcagggaaatagcgctcaagcagctgcttgacatacattctgacaggcggcgaacatagaaggatcggcacttcctgcctcaatgagagctgttcgatttctcttgctacagattgaatgatattttcggataatgttggttcaagagataaaaagttgccgtgttcagtctgctgaattccttccgccacggccttttcgacgcggcccgaacaagtcaccactttcagcgtctcattttccttcgcatattgggcggtgatctgcttggccagagcctgtctgacatactcggtcagcatatctgaatccgtcgtcagctttccgtagtcggccagcgtttcaaagattgtcaccaagttcctgatcgatactttttctttcagaagttttgccagcactttctgaatgtcaccgacagacagcggattcggcgagacctcttcgaccagtacaggataagattctttcaagtggtcgatcagctgtttcgtttcctgtcttccgatcagctcatgggcgtgctttttcacctgctccgtaatatgggtcgatacgactgaagccggatcgacaaccgtgtacccgagcatttcggcctgatctttctgagattccggtatccatttagccggaagaccgaaggacggttcgattgtgtcaatcccttcgatctgatcgtcttcgcctgtcggagacatcgccagaaagtgatcgaggagaagctcgcctttcgcgacttcgtttcctttaattttgagcctgtactcgttcggctgaagagcgatgttatccctgattctgaccaccggaatgacaagtccgagttcaagcgcgagctggcgcctgatcatgacaattctgtccaacagatcgccgccctgatttgcatctgcaagcggaatcaatccgtagccgaattcaaactcgatcggatcaatatcaagcagatggacgacgctttcggggctttttaattcatccacttcagcttcttcctcaaggatatcctccactttttccttctcttcaccggctttggagagcatatagccgcctgcggcgagaagaagagccagagggcctgtcaggagaatgccgatcggcgtgaaaatcccgagcaggaaaatcgttcccgccgtgacatacaaaagcttcggataggcaaacagctggcctgtaatatcgtggccgaggtttccgtccgacgccgctcttgtcacgacgatacccgtcgccgttgagatcaagagcgcaggcagctgagatacgattccgtcgcctacagacaggagtgtaaagtgtgaagcggcttcctgaatgctcatttgtttttgcagcatgccgatgacaattccgaaaatgacgttgataaggacgatgatgatccctgcgatcgcatcccctttcacgaatttgctcgctccgtccatcgctccatagaagtcggcttcacgggccaccttctcacggcgcaccttcgcttcctgctcggtcaccattccggcattcaaatcggcatcaatgctcatctgttttcccggcatggcgtcgagcgtgaatctggcagcaacttcagatacccgttccgcccctttcgttatgacgataaattgaataatgatcaaaatgataaagacaacgagaccgaccaaaacgtttccgccgacaacgaaagacccgaacgtctcgactacttttcccgcatcaccgttggacagaatcgaacgcgtcgtcgatacattcagcccaaggcggaacagcgtcaagaggagcagcaaagaaggaaaaatcgaaaattgcagcggttcttgcatgttcattgtggtgagaagcacgattaacgcaagagaaatattaacgataattaagatgctcaacatccatgttggaaagggtatgataagcattgccacaatgaggacaacgccggataaaatagataaatctcttgcagacatgctgtttctctccttttaaaactgaaaaattcactagattttttgctttgttttgtaaacataggccaggatttcggctacggccttaaagaattcttccggaacggcctggtcgatctcaacctggtcatagagcgcccttgccaaaggcctgttctcgaccgtcatgacatcgtgttctttggcgatctgcctgattttcagagccattagatcgaccccttttgcgatgataaacggcgcatccattttgttttcgtcgtatttcaatgcgacggcgtaatgggtcgggtttgtgatgatgacatccgcttttggcacttcctgcatcatgcggcgcatcgccatttccttttgcttctgtttgatcttcgacttgatcagaggatcgccttcggtttttttgtattcgtctttgatgtcctgttttgacatgcgaatatttttttcatagtcaaatttttgatagaggtaatcgagcaccgcgagaaaaattaatgcgactgcagcggaaacccccattaaaaaggtgagccagccgacatatgacaaagcctcgccagccgacagcgccgggattctgagaattttgtcaaagttcagccataaaacggcgaatgtcacgcctccgacaatcacgatttttaaaatcgatttaagcagttcaacgatcgccctgatgctgtaaatccgcttgaatccattaagcgggtcaagctttttcaaatcaggcttgatcgcttcaggggcaaataaaaacccgacttgcatatagttgctcaataccccagagacgacggctgtcagcaaaagcggtgccataatgaggcccgattcaagcacaacactttgaaacaggccgggaatattggcgactgacaccttcatcgtgattaattctttgtaatacttttcgatcaggccgagcaggcggtctctcataaaaggtccgatgaataaaaaggataaaaacacgatgagaagagtgaccgccgtattgacatctgcacttttggcaacctgacctttttttctgctttcccgccgttttttcggcgtcgctttttccgttttttcacctgcgaaaaattgcaaatccaacgtcagcttcatcatgccaccccaagcaaagttaatagatctctcattgtccgaatggcaaattcgaagacgtgctgcatcatgctgaacataacggccatgcagatgatgagcatgataaaggtgatcgcgattttcaaaggaagcccgacgacaaacacgttgagctgcggcaccgttctcgccacaatccccaatgccagatcgactaaaaacaaacaagccacaacaggcgcagacaattgaaatgctgtaataaacatcgtattgaagctttttgcgataaactcggcaaattcttcgcttccaaacgacagcgccatcttgtcgaccggaatgtattgatagctgtaatagatcccgtcaagcaggagatgatgcgcattcaggctcagcatgagaagcagcgccatcgtatataaaaactggccgacaagcgggctttgcgcccctgtctgtggatcgatcacattcgccaccgcaaatcccatttgaaaatcaatgaacgatccggcgatttgaacggctgagatcatcatgtaagcgatcagcccaagcagaagtccgatgagcgcttccttcatggccaacatcatgtaaattccgtcaacgtcaaggtgaggaggcttttcaatcgcttgaaaactgacgagcgcaagaaaaaatgcaaaacctattttatgaacggccggaattgtccgataagaaaatagaggcaccgttacatagaatgctgtgattctgacaaacacaagtaaaaaggctggaaatgattcgattattgacatgttaaaactaccctgcaaaacggtttaaattagagaacagctcagtcgcgaatgacaaaatcgtcgacagcatccacgggccgaaaacgacgagtccgaccaaaacggcgacgattttcggaatgaatgcaagagtctgttcctgtatttgggtggttgcctgaaaaacgctgacgatcagcccgacgagaagagcgagcgccaaaagcggcccgctgataagcaatgtaacgtatacagccctttcagccatcgatataacaaattctgaattcatgtattagcacctactctaaaagctttgcagcaaagatttaacgattaaataccagccatctacaagcacaaacagcaaaatcttaaacggcagtgaaatcatgaccggcggaagcatcatcatccccatcgacatcaaaacacttgccacaaccatatcgataatcagaaacggtataaatatcataaatcccatttgaaacgcggttttcaattccgagatgacaaacgcaggaaccatagttgaaagcggaatatcattgatggactcaggcgtttccatctttgcgtaattcataaataaagccagatctttctgtcttgtatgcttgctcataaatgttttgatcggggcttccgcttttgtataagcttcatccaaggtgattttattgttcattaaaggcgtcagcgcttctttattaatctctgaaaaagtcggccccataatgaaaaatgtcaggaacagtgcaagtccgatcagcacctggtttgggggcattgactgtgttgccagcgatgtccggacaaaggacaggacgatgacaacccttgtgaaacaagtcatcaagatcaagatacccggagcgatcgaaaatactgtcaaaagcagcaagagccggacgctggcgctgacatttgccgcatcgcttgaattaaataaatccataaactcattcatgttgattttggcctttctttctgccttctgcgcgattttgtttcagttccgcaagctgtgcttttaacgactcggaaaaagatgccgtgccgctttgtttttgcacgcctggaactttgacttgatccatccatttctgccattcaatcttgctgttcatcgcagcttcatgctgcgtgagaatttctttatattccttttcatcatcgatctctttcagcagctggatattttcgccgacaccgacgaccagcaccctgtttcctactttaatcagctgtacggacttgttttgcccgagtgaagtcccgccgatgttttcaacatactggaagggttttagcaaacggttgcgtttattcatgaatttgaccaaagcatagatcagaaaaatgacgaacagtaacgcgccgatcattttcacaaaatcaaatatggaaacggaaggagacgggggttcggtctccgcctcttcctttagagaacttttttcctcggttttgtctttgtcttttgctttttctttctctttgcccgcacctttttgctcaaacagatgatcaacggtctggtcccccgattcctctgcgagagccggagcgtacggcaatgcgagaaaggcgcatagacaaaggccggctatgaaaataagaggtttcttaaacaagttgtacaccctttagcttagcgttttattgatggcttccatgacgcggtcagcctggaacggtttgacgataaagtctttcgctcccgcctggatggcgtcgataaccatcgattgttggcccattgccgaacacatgatgatttttgcctgcggatcgatttccttgatttctttaagagccgtgattccgtctttttccggcatcgtgatatccattgtgacaagatcaggtgaatgctctttatacttttcaacagcctgtgccccgtcttgcgcttctgcgacgacttcaaagccgtttttcaccaaaatatctttaatcatcattctcataaatgctgcatcatcaactactaaaatcttgtaagccattattaatctctccaatcaatctgttattatcgtaatttgctgattcgttcagcctgactcaaaatgtctgtcaccctgacgccgaagttttcgtctatgacgacgacttcgcctttagcaacgacgcgctggttgaccaagatgtcaacaggctcaccggcgagtttgtcaagctcaatgatactgccggttgacagttcaagcacctctttgacgctgcggtttgtcctccccagctcgaccgtgacggacaaaggaatatccatgagcatgtcaaggttttgaaggtgcggctgcgcttcagtctgaggggcaaaggattgaaactctgccggtgccacctgcacaggctctgaaacttttgccgtcccttgccgtttaggcgcaggctcctgtctctgtgtctgagcaggtgccgaattcggattaggcgccggtttttcctgtacgggcgtctgtacctcttcagtcttcacaggctcttctccgccgtcctgatttgttaattcatcaatcagatcttttgcaaaggtcagcggataaagctgcataatatgcgaatcgatcagatctccgacttttagtctgaaagatactttgacgagcgggtcctctttcggaatttgctctgtcccttccccttctttcacatcaaggaggtcaacttccggcggagaaatatcgatcttcttgctgaagacggtggacatcgatgtcgcagcggaacccatcatttggttcatcgcttcctgaacggcgcttagatgaatttcgccaagcgacggatctgcgttcgtcccgtctccccccatcatcaagtcagcaatgatcgcggcatcttcctgcttgatgacgagaagattgtttcctgaaaaaccttctgtatagctcacaccgattgaaacatacgggtgcgggaactcatcatttaaatggcttttttcaatcaccgaaacagtcggcgttgtaatttcgactttttgattcaataaagtggacaaagctgttgcagagctcccaaaggaaatgtttccgatttccccgatcgtatcctgttccatcagggacaaccctgattctggctgctcttgagccgtatcatcgccgcctttaagcagcgcatcaatttcatcctgtgataacctattgttattctccatattcttcacctcttatgtcgtgatctagaatttgaatcgcagtctttcgattcattcggccggcttgtgctagaaatttcggtttatctccgaccaaaacagtaagaggttctgctactgatttgtccaaagtgatacaatctccaatttctaaatttaaaaactcttcaatggttaattccgatgatccgagttctgcgacaattggaatttgcgccgtcaaaatccgcttttctatcgactttgtttcctccggttttggttcaattctgtctgattgcatccagtagtgaacggaaagcttaggaatgatcggttccaggacgacgtgcgggatgcacaggttgataaccccgctgatgtctcctatttgcgtgttcagcgaaatgacaacgaccgtctcattcggcgataccatttgcacaaactgcggattcacttcaaaatcggacatttccggctcgatttccgtgatggattcccacgcatctttgtaattcgtgagacagctttcgaataaattggacatgattttcgtctcaatctccgtcatgctgtcaattttgttgtggctcgagccgatcccgcccatcacccggtccatcatcgtataggcgatggtcgggttgatctccatcatgattcttccttcaagagggcgaacctcaaacagattgaggatcgtcatattcggaatcgatctgatgaattcctcatacggaacctgatcaaccgagctgaccgagatttggatataggttctcaactgagctgagaaataagtcgttagcagccttgcaaagttatcgtgaatcctggtcaagctgcggatttgatcctttgaaaagcggagcgcccgtttaaagtcatagacttttacttttttaacggactcttcttttttcagctcgtcggcgtccatttcaccggtcgatatcgctgaaagcagtgcatcgatttcattttgggagagcacttctcctgccatctgttttcacctccatggttctgtcatctatgttcctactgcagattaaaggaggtaatgtacacagttttcacttttccctctttcatgtagttcgtgttcagcttttctttcagctgttctttaaatttttcttttcctttttgtccttcaagctcatctgcgttcgtgttcgccaaaagggagatgactgaatctttaatttggaaatcccgcttttcaagctcttctttcgcctctttcgaatcggtttcaagcttgattgacaaacggactacattgtctgatttcaagtttgtcgtgatttcggcgacttcaactgaagattcgaccacttcatcgatcgaaggttctgcgttttgatctttttcacttgcgcttcccttgatgacaaagaacgcagcggttcccaacacagcaattgccaaaataatcgtcatcataattcctagaagttttttattcattcagattcctcaattctttggtcacaagaaagtatttggattttttgatagaatgacacgattgtatccacaactgtatcttcatcttctttgacaacaaacttttttccgttggacagcgtaattgtcgtatccggaaaacattcaatttgctcaatgaatagtgcattcagaataaagggctgtccgtttaatcgcgtaactttgatcatgtgttatcaagaggcgccttcacgagggcgcctccttccctcctatcgcttcagattgacgagttcctgaagaatttcatcagaggttgtaatgattttcgcattggactggaagccgcgctgcgcgataatcatttcggaaaattcttctgaaaggtcgacgttcgacatttcaagcgcactcgtttgaatttttcctgagccgccttccccaggtacaacgacttgcggatctcccgaactcaatgtttcgcggtaaaggttgtctccagcttttgataatccggatgtgttgctgaatgtcgcaagcgagatctggccggcggtctggttctcgttgttttgatcgacataagaaacggttccatcaggagcgatgctgaagctttgcgcgtcttgcggaatgttgattcttccattattggccgttaagacgaacagcccgtcaacagtgacgaggtcaccttcatcagatcggtagaagtttcctgatcttgtgtagtacacttcatctcctgatccgacgcggaagtagccgtctcctgtaatggtcatgtcaagctggcggcctgttgtcgaaggcgctgcgtttgtgtgaatgatatcgatcgatccgatcgttgcaccgagtccgacctgctggccgtttacagagccgcggtttgcagtagacgacgacgcgccggaaagctgctggctgacaatatctttaaacgtaacccggcttttcttatagcctgccgtattgatattcgagatgttgttggcgacgacatcaagctttgtctgaaagtttttcatgccgctgattcctgagtatagtgaacgtaacataattattcctccctgaattgtctgtttttatttatcagaatggcttaccgccgtcacattccacggattgacttcggttccatcgtcaaggacaagcagatactgtccgtctgagcttttaactgatttgacgagcgccgttttttcttcgctgtcttcgccttcataggtgacttcttttccgatccagctgacatacatcgtcatcgggtcctgaagtccgacgaacgtcgacatcgttgtgttcagattcgttagctgctctaggcttgaaaaggtcgccatttgcgcaatgaattcgcggtcttccatcggatttaagggatcttggtactgcagttgtttcatcagcagtttcaaaaattcatccttcccaagattggagccgctccctgctttctcggctttttttgcctcggataaaaaatcggatgtcgtcgatttcgtgtttgttgttcctaaggcggttctggtatcaattgaagtatcagacattagatctcctcctcgctgtcctgtgatcgagtctcgataagctcatccagaaactcctgaaaatcctcattttcctgcttactttgctgatcttgcttcggctgatgctggtttttctcatcgtccgccagctgtccgaaagtctgatcgctgttttgaagcggaacaccgaagcggtcaatttgcacagacatgttgggcagcgcctgtttaagatgcgcgagattgtgttcgagcagctctttagccgactgggtcgatgcgatgattttgcttgaaaacatcccgtgctgtttgacgagcttgatcgtgataaagccaagattttcaggattcaggcggatcgtgaaactgcctgtcgacctgccgaacggcgtatacttcatctgtttccatgagctgagaatttgttctgaaaagcttttcggctgagcggaagcttcctctgccgccgaaggctggagaccctggatcagcgctgtgcctgtccgatgattggccagtacagaggattgaatcggctgttccttttggccttgctttccttcagtttgaatttctcttctgttcaaaacaaaggacaacggcttctcagaaagagaaacatcggttttcttgctcatgagcattgccttgagttcgctttcggccattttccactctttttgatccggttcagcgtttgcgttcatcatctgctccattaagcttttcaagcttttcagctcggtgtttgacatggacaaaagctgcgattggctcggatctttcgtgaaaaattgacgtttaagctcatcaatcagcccttctgctcccgcctttgtttgaagagcggcgagaaattccggcgcctgtttcaataattctgcgatttgcgaagttttgagtgacggttgattttcatttacaatcgcagctagcagctgctgaatctggccgagaatttgcaggtcgggctttttcggctcttctgtcccgctttcgtcggcaggcaaagctttagcatcagccgttttgcctgattgttcaggcagggcggctttttcaagcagctcttttatttgttgcagcagctgttctgccaatgccagttcatccggagatgcattcagctcttcaagctgctgaagggaattcagccagtcttcattgaaagagctgtcttccttatttgaaagccattgcttcagttcatgcaaaagcccttccaacggcgtatcctgagaaggctcttctcccttttgaaaaggggaaagtgagctgttttccttctggagcacattctgaaagagcgcgcccaacggcgtcctgctcgtttttgcaggtgcagtgtccaccgcaggtttggcatcaaaggagattgcgtcaaaaagcctcaagctattccccccccttcttttttcgcttcgtttttcgcctcgtttttcacaagcttttctgtgaatacagccgctttatcaggagacatttttgagaggatctcagtcactttctttttgcttaaagaatctaaaatattgattgcctcttcctcttttaattcgcttaaaatttttgcagctttattgctttgcatgctttcataaattttgacgacttttccgtctccttgaccttcggcgttctttttatcctgctctttttcatctttttccgttttttcgagcgagctgattttttgtttcagccttttaatctcttgatcactcgtttttaagtcactcgtcagcgtttcgatttcgcttttttgttcatcgatcgtcttttggagcttttctgctttgttctcctgctgtttagttgcgtgatctatgtcctgatcctcgccgtttttcacaagctcttttacgacgggaatttttgaggctgcatcctgaaaattgacgcccaaaagccacatgccgacgaacgctacaacgattaaaaagatcagcggaatgacgatgacaaacaaaaatgtctgaaatttaccggcttttttttcttcggtcatcgtttttctacccctagcttccttgagttatgtactgggcaatggagatatcgtccatttcctttaactcatttgctttgttttgcagcgaatacatttcaaactgcttttctttcattttttcaaattttttcagctcgatatttttctccgtcaaatcgtgctgtttttcattcatttcatttctcttcatcatgacgagcttttgataatggtagattgtcgtttcaagatttgtgacaaattgctgataatgccgcatttcctgaacgctcatccccgtctgcatcttgatttccttgtttttttccagcgtttctttttggctcatgctttcatacagcttttccgcgaccttttcgaattcggaaactgagtgctgatattcagcaaatgattggtctttttcattttctttaagctcgaggagcttttgaaatttaaatgaataagccattcttaatcctctcttcctgtaagactctttaataaggaaatgctctcttccagcgatgccgcttcatccacttcctgcttgaggaagctgatcagcttagggtggaattgtatggcctcatcaatttctctggaagacccttttttataggcccctatgttgatcagatcctctgagttttgataggttgacagcatttccctgaaccggttcgctgctctgatatggtctttctcggcgatgttcgacatcaccctgctgatgctttttaaaatgttgactgccggaaactggcctttattcgcaagggctcggtcaagaacgatatggccgtccaagattccccttacagtatcggcgatcggttcattcatatcatcgccgtcgacaagaaccgtatagaaagcagttattgacccgctttccgtcgttcctgttcgttctaagagcttaggtaaaatagcgaacactgagggtgtataaccttttgtcgtcggcggttcgcccgtcgccaggccgatttccctctgggccatggcgacccttgtcaccgagtccatcatgaacatgacgttttgtcctttgtcgcggaagtactcggcaatcgctgttgctgtataggccgctttcagacgcatcagcgccggctggtcagatgtagccactacaacgatcgttcgcttcagcccttcttcgccgagatctttctctatgaactccctgacttcccggccccgctctccgacaagagcgatgacattcaagtctgcggccgtctctctcgcaatcattcccataagcgtgctttttccgacgccgcttccggcgaatatcccgacacgctgtccttttccgacggtcagcagactgtcgatcgatctgacgccgaccgccattttttctctgatcggcggccttttcatcggattaggcggcgcctggtctgtcgatacttgagccagacctttcggaagcacgctgccgtcaagcggattgccgaatgcatcgacaacttgtccgatcaacccggagccgactttgaccctaagcgattcgcccgtcgcttcgacaatgctgccgggggcaatattggccgcttccaaatatggcatcagaagaatattttggtctttgaagccgacaacttcagctttaatagcctttggcccgtcaccttttgtatagattttgcagacatcgccgattgaacattcaggtcctttggattcaatcatcaggccgaccgcctgtttgacttttccgtatcgtttgtaggaatctgcggtttctatacattcaagcagctgcttgagcatcaccggacaacacctgccgtttcaagcaggctgagcagtttttgtttcagctgctgcaattgagtgtcgatgcctgcatcgattcttccgaaagccgtttcaacatagcacgttcctttcggcgctttttcatcggcgtatatcgcgatatgggcgccgtattggaggagctgctcaagttcgtttttgtggctttgaacctcggtgtagtactccggatctacatagatggcaatgtcatcgaattccttaatttccgacagcacctgttttacgagggctgtaaaagcttctttgtcgtcagccttttgattccaaacttttttagccagtgacacggcaagttcgacaatttcttcggatgattgttcgattttttcttcatagtcacgtctagccgcccggacgatggcattggcttcatccaaatacgcttgataagcgcttcgggcctcggcctttccctcttcaaatccagcttgaaagccttcttgtttcgcctggtctatcagcgcttcgcgttctgtttcccagcttgaccgttcctcttcgatttgccgtctgacctgttcgagttcagcgctcgctttttcgtatatttttccggcttcttgtctggcatggtcgaggaggtattccggatcctgtccggtatcaagttcggtttctgtctcaggaagtttgacttcctttaatgaaatcgtccgcctttctttttgcggtattgatgataatcgctgtttaataatgttagacaatgatatcatctcctccgcctctggcgattacgatctcacctgcttcttcaagtcttcggatgacgcttacgattctcgattgagcttcttctacgtcacgcagacgcacagggcccatgaattccatttcctctttaaatgtttcagccatacgctgcgacatgttgctgaagacgatgtctttgacctcttcgctggccactttgagagaaagaagcagatcgtcgttttccacatcgcggataaccctttgaatagcgcggttatcaagcgtaacgatatcttcaaagacgaacatccgctttttaatctcgtcggcaagctcaggatcctgaatttcaagggcgtcaaggatcgttttctccgtacctctgtcaactccgttcaacacttcgactacggcttcgataccgccggtctgcgtgtagtcctgagtgaatgtggacgatagcttttgctccagaatctgttcgacttcattgatgatttccggcgacgtcctgtccataacagcgatccttcttgcaacctctgcctgcacatcctgattcagctctgacaatatctgacccgattgcacgggatcgagataagacagaatcaatgcgatcgtctgcgggtgctcatgctggataaagttcagaatctgctcgggatccgcttttctggcaaaatcgaacggtctgacttgaagagacgatgtcagcctgttgataatgctggcggctttgtcttcgccgagcgctttgtcaagcacctgcttggcgtaatgaatgccgccttgagaaatatattcttgagcaatagccgtttcatgaaattcctgaataatctcatcttttttctcaggtgatacagctctgacatttgatatttcaagcgtcagcctttcgatctcttcatctgttaaatgcttgtaaacggaagctgacacatcaagccctaaggatatcatgagaatggccgctttttgtttgcctgtaagcctgtcttgtttcatttttgccatttcaatactcctcctaatcctcggtcagccagctgcgcagtaatttggcgaattcttcaggcttgtctttcgccattttttcaagctgttttcgtctgacagtttcttctgtctctttttcattgttcacatcagcaacccgaatcggctcctgaggcgtttcataccattcttcctcgtattcgtcatctctatttttacgtcttctgacaagccagatgatgaggccgattacagcaacaagcgctgctccgcctgcgatgtaagcccacatcggtatgccgcctgtttccgttccttcatcgattgtctgcttgccgtcgaacgattggacagaaacaacgattttattttcaacatcctcatctgtcagaggctcttcttcatagttcttgtcaatcgatgttttcacaatggttgagaggatttttttaatatcgtcctccctttcagcaggcagtgactgcgggttgtttgcatcaggcggttcaaccatgacctggacgcccagatctctgattttgtacgggctctcagcgatttctttatggattctgttgacttcattgttgattcgttcttcgcttttctcatagtctccgttgcctgttccgccttctgtttcagcatagttcgttacatcgttttcacctgttccgttgacgcctcccgcttgtgctccctgtccggaatatgtttcactgacgcgctctgcgctgaccgtgattccttccatattttctttgtcgacaggttcaaccaggtcttccgtcctgttttcttttgtgaaatcgatgtcagatgtgacggatacaaccactttatcctgtcccatcatcgtgccgagcatggtttggatttgtctttgcaggtccttttcgatctgggccttgacttccctttgggaagaatagctgtcggcgtaagaaccggactctttgcctgtttgatcgtaatatgtggagttttgatccatgatcacgatgtttttcgggtcaaggttcggcacgcttttcgatacgagatgataaaggccgttgatttcattttgatcaagcgtgtggccgggcttcacctgaagaacaatcgaagcggatgcttccggcttttcctctccgacaaagacggattccttcggcaggttaatcataaccttcgaatctttaatcccgtctattcctttgatgaggttggatagctcggtttgcgtggctttcactttcaaaacgtcaaattcgttgtccgtcatgccgaaaccggcattttcgccaaagaatgaataatcgatgctcccgcttttcggaaggccctctgcggcaagatcgactttcagttcatcgactttttcttccggaactttgatgactgaaccgtcagtcgcaacttcagatggaatacctttttcatcgagcacctgtttgatttggccggtttcttcagctgacaaatctttatagagcggcaccattttatttgacgaagcaacaattccaatgatgattgacaggatgactgccagagcgacaatgccgatcagcagaatcttctgcagctttgatctgtttttccaaaaatcagttattttcgttttaatttgcaataaattacgattcatcttactcccccggtagttacactaattctcttcgctttcagactcctttcttacatttgcattctcatgatttcctgataagcttcaaccgctttgttgcggaattccgtcgcagccgtcaatgtaatgtttgccttctgggctgcaatcatcacttcatcaaggttgacatcctgaccgagagcaagcgcgtttgtcagtttatcagattcattttgagattgattcaaagcattgatagaatctttcagcacgttggaaaagctgacttggttctctgaaccgtcctgcttgttcttgatctgatttgttgcattcgttcccgcctgcacggattgaactccaaacggagagattccattaaccattcgtgtcatcaccctactttccgatttctaatgctttcatcagcattccttttgtcgcgttcattgctgtgacattggcttcatatgaccttgtgctgctcattaaatcgaccatctcttttagcggatcgacattcggcatctgcacgtatccgtcttcgtttgcgtcgggatgggtcggatcataaacgagcttaaacggtgttttgtcttcgcttatcttggtcaccttcaccccttcgccgactctcgccgatgcattcatcgatgattggagaacggatgaaaaggattcgcctttcggagccgtcgatacaagctttcttctatacggctgccactgtccgtcaaccagcttcgctctcgtcgtatccatgtttgccaggttggaagaaacggtatccattctgactctctgtgcagtcaacgctgaagctgaaatgttgatgctattgaatacccccattatttacctcctgtaatcgcggttcttagcgagttgaattttccgcttattctttcaaccagcgcttgatactggatttgatttttcgccatttcactcatttcctgatcaacgtccacattgttcccgttttcttgataagttgtattctttctcgacacaactgaataatttggctcattccctttaaagtcaatgtgtctatagtctgtttttatggcattaatccgggaggactcctcattcagcacatttttgaaggatacttttttcgccttgtagttcggtgtatctacattggccagattgttcgttatgactttttgcttaatgttcgcttgattcaaggctccctctagtctatgtatcgttcctgaaaatatatccaccgtccaaatacctccaatctttttccatctgtcttaaaatcttgtcgagaattgtaaaaaccataagcctattgtaaggaataataggcttaaagtctatgatctggaagcaaaaaaaaatcgtaagaaatatctattttataaataggtattttgacctagattataagaactatgtaatgttacgttcattaaagtttcaaaaaattatgttagtatatcttttatttaagtaacgcattgattttgcaccgcgttttagttgttttttgatatgaaaaaattacgataatatagtttaaaacatgaaataaaaaaagccgcagaacggcatgttctgcggctttcgccttttaatgagactttagtttttctaactccatcaaaaatttgttgttcagcactttgatgtatgtgcctttcatccctagtgaccttgattcaatgacaccggcgctttcaagtttacggagcgcgttgacaatgaccgagcgggtgatgccgacgcggtctgcaattttactagcgacaagcaggccttcatttccgtcaagctcctcaaaaatatgttcaattgcttcaagctcgctgtaagatagtgaactgatcgccatttgaacgaccgctttgctgcgcgcttcctcttcgatctcttccgctttctctctgagaatttccattcctacgacagtggcgccatattcggcaaggatcagatcgtcatcctcgaatttctcctgaaggcgggacagaatcaaggtgcccagtctttcgcctcctccgatgatcggaacgaccgtggtcagacccgcttggaacaaatcgcggttttccacagggaaagctgtgtattcgctgttgatgtcaaggttagatgacgtttccggaatgttgaacaggctttttgtataatcttcaggaaactggcgctcttcaagcatttttttcatccggtcattttcgatctgctggttgatcgagaaaccgagaagctttcctctgcggctgacgacgaaaatgttcgaatcaatcacatcgcgaagcgtttcggccatttctttaaaattaaccggcttccctgccgcattttgcagcattgcattaatctttcttgttttttgtaataaagccataataaattgatcctcctaaattactcttatttaattgtttataaaataaactggcttaaatccttattcttagcgatcgaaccgagcttttcttcaacatattgaggcgtgatgaccacttcttccatcgtcacatccggagcctcgaatgacagttcttccaaaagacgttccaaaatggtgtgaagccttctcgccccaatattgtctgtgtcctggttcacatgataagccacttctgcaatcttacgaatagcatcgtcagaaaattcaagagatataccttccgtcttcaataaagccttatactgcttaagaagagcgttgtcaggctcagttaaaattttcacaaagtcatcgatgctcagcttttgaagctcaacgcgtattggaaagcgcccctgcagctcaggaattagatctgaaggcttcgccatgtggaatgcacctgcagcaatgaacagaacgtgatccgttttgaccgcaccgtactttgtcatgacggtagatccttcaacaatcggaagaatatcgcgctgcacgccttctcttgagacgtctgccgatgaagaagcaccgctctttttggcgattttatcgatctcatcgataaagatgattcccgactgttcggctctctggacagcttcctgggcagcttcgtccatatcgatgagctttgccgcttcttcattcgtcagcacttttcgcgcttccctgaccgtaagcttgcggcgctttttctttttcggcatcaggctgctgagcgcatcctgcatgttcatgcccatctgttccatacccgagccttggagcatatcaaacatggacggctgctgctcctccacctcaacggtgacataatggtcttcaagttcgccgagagcaagctgatgcgcaatccgtttccggttgttttcgatatccgcgtcttcttgcttttccgcttcaccagtttcttgatcctgatttccgccaaacagcatttcaaaaggatttttcgcacctgtctgtttttttcttcccggtacaagcaggcggacgaggcgtttatttgcgttttcttcagcgatgcctttcacttcgttcattttttcctctttgacgaggcggactgacgtttccacaagatccctgaccatcgactccacatctctgcccacataaccgacttccgtgaacttcgtcgcttcgattttgacgaacggagcgccgacgagttttgcgattcgtcttgcaatctcggtttttcccacacctgtcgggcccatcatcaatatgtttttcggaacgatttcttcgcgcagtttttcatcaagaagacttcttctgtagcggttcctcaatgccacggcgaccgcttttttcgcattgagctggccgacgatgtattgatcaagcctttcgacgatctgcctaggagtcagcggctttttttccatatgcctcatatcctttctattcaagttcttctacaatgatctgatcgttcgtatacacacagatttcgcccgcggtttcaagtgaagccctcgcaatcgctttcgcgtcaagctggctgccggcatgacgtttcagcgcccttccggctgcaagcgcgtagtttccacctgagccgatcgccaaaatgccgtcgtccggttcaatcacttcgcctgttccggaaacgagcagcatgctgtcggcattcatgacgatcagcatcgcctcaagctttctgaggactttatcgcttcgccactcttttgcaagctcgactgccgcccgctgcaaattgccgttgtattcttcaagcttcgcttcaaacatttcaaagagcgtgaaagcgtctgcaacagaaccggcaaaaccggcaatgacctttccgttgaagagttttcttacctttcttgcggtatgcttcatgacgacagcctgaccgaacgtaacctggccgtctcccgccatcgcgctatttccgttgtgctggacggcaaatatcgtcgttgcgtgaaaagatgacataaaagaacctcctttatttccctttatgtgcccgagggtgatgagacatatatgtctttctgagcatatctttagatacatgcgtatacacctgggttgaagaaagatttgaatgcccaagcagttcctgaacgctcctcagatccgcaccctcatttaacaaatgggtggcaaatgtatggcggagcatatgcggatgtatatgtaatgtacccgaagtcttcttgaccagttctcccaaaatgtaacgaacccccctcggggttaagggcccgcccctttgattcaaaaaaataaaagggcggggctctttcgcttttaacagaaggatgcgtcttccattttgcaaatacagatccaaagcctcccgggcgaatgaaccaaatggaatatacctttgcttcctgcctttcccgtggaccaaaaccgtatctaaaaacagatccaaatcagattccttcaggctgcaaagttcgcttacccgcatgcctgtcgcgtagagaaattccaggagcgcctgatttctttggccgagcggtgtactcaaatccgaaacctcaaacagttcttcaagttccttttcatataaaaacttcggaatccgcttatcctgtttcgggagactgacaagcagaaacgggttttcttttaccagcttttcccttaataaaaatttatagaagctacgcagagccgaaattttcttgctgatcgtcctgcgagtgagccctttttcatgcgcttccgtcaagaaaattctcacatccggataagtcacgtcttcaaaaccctttatgccctgaacgtgtaaaaagcgttcaaagtcttcaatggaagaaatgtaacccacaattgtatattttgaataattcttttctatttgtaaatattcaatgaataaagttaaaaaattcttaacatttgccatcattacacctcttcgaaaagggcttttaaatgttatcacataacaagttcatctggcaatgaataactatagcgttttcgaaatatttcgaattgtctccaatgcgcgcgaagcatactgttcatttcgttcctgcttgtttttaattttaacacccaattctttgaacaggccgaagtttgcattcatcggctggaagtttttcttgtttgtttccgtaatgtaatgggccatgctgccgatcgctgtttcatttgaaaaagtgacaggttcttttccctggatgagccgagccgcatttataccggcaacaagacctgaagccgctgattcaacatacccttcaacacctgtcatttgaccggcaaaaaacagatcgtcccgctttttaaactggtaggtcgcttttaacagactcggcgagttgatgaacgtatttctgtgcatcacgccgtagcggacgatttctgcctgttccagtcccggaatgaggcggagcacttctttttggtcgccccatttgaggtgggtttgaaaaccgacgatattgtaaagcgtgccggctgcatcatcttggcgcagctgcacaacggcgtacggacgctttcctgtttttgggtcttcaagtccgacaggcttcatcgggccgaacagcatggtttttttgccgcgcttcgccatgacttcaatcggcatacagccttcaaagaagatttccttttcaaattctttcaatggaacggtttccgcagacacaagggcgtcataaaacctgtcaaactcttcttctgtcatcggacagttcaaatacgctgcctcccctttgtcatagcgggatttcaaatagactttatccatgtcaaggctgtctttttcaacaatcggcgcagccgcgtcataaaagtatagatagtcctcgcctgtcagctcccggagctttgcggaaagcgcttctgatgtcagcggtcctgtcgcaatgattgtcggtccttccggtatttccgtgacttcttcatgaagcacggtcacattcggatgattctttactttttcggtaacgtttgcggcaaattcatgcctgtctacggcaagcgcaccgccggcaggaacagaacattcgtcagcagcagcgatgatggccgagtcaagaacccgcatttcttcctttaatacaccgacagcattcgttaatgaattcgcccgaagcgagttgctgcagacaagttcggcaaatttatctgtatggtgcgccggcgtttgcttgactggcctcatttcgtataaacggacattgataccgcgcttagcaagctgccatgccgcttcgcttcctgcaagtcctgcaccgatgacatttactgtttgattcatattcacatctcctaatttatgaattgacttattcttttaacacaacaaagaaggtgagcaaagccctgctcaccgctacttttgttgttcttccttataatcgcaattaacgcactgcacttgaacgccttttttgagctttttctccacaagcatgtcctcgcatttcggacatttccgttcaagcggtttatcccatgatacgaattcacattcaggatagcggtcacagccgtaaaaaatgcggcgttttttcgatttgcgctcgacgatgttgccggttttgcatgatgggcatttgacgccgatctcttttacgatcggcttggtgttgcggcagtccggaaaattggagcaggccataaatttgccgtaccggcccattttatagaccatcggatgtccgcacgcttcacagtcaacacctgcatactccggttcgatctccacttcctgcatctcggcttccgctttttcaacgcgcttttcaaagtccttgtaaaaggaatcaattatctgcacccattgaatgtttccgtcttcaacgtcatcaagctctttttccattttggcggtgaactcaacgttaataatctcagggaaaaactccatgatcaagtcaagcacaatttcaccgagctcagtcggaataaagcgtttattatcaagggcgacatacccgcgcttttggatcgtgtcaagcgtcggcgcgtatgtggatggacgtccgattcccagttcttcaagcgttttgaccagccttgcttccgtatagcgcggaggcggctgtgtgaagtgctgttcgggctcgatgtcttttgaaagcacggtatcgccttcagcgagatccggaagcatcttattcttctcttccatctgatcgtctttgccttcaacgtacactttcatgaagcctgaaaacttgactttactgccgtttgcccgaaatgtcaacccgttgttttcaaggtcgacgctcatcgtatccagtgtcgccggagccatttggcttgcgacaaagcgctcccagatcagcttgtatagccgaagctggtctcttcccaataccgccttcagatcggaaggctttctgagcaccgaggtcggcctgatcgcttcgtgggcatcctgggcgttttcattctttttggccggctttcgcttgctacccaaaaattcttttccgtactgttcgccgatgaatgatgccgcttcttcttgagcagtattcgagatacgggttgaatccgttctcatataagtgattaacccgaccgttccttctttgccgagatcgattccttcataaagctgctgggcgatcatcatcgttttctttgcccggaaattcaatttgcgcgccgcttcctgctgaagcgtcgacgtcgtaaatgggagcgcaggatttcgcttccgttcttttttcgttacctttttgacctcaaatttgttccctttgatccgggataggatttgcttcacatcatcttcgcttttcagctggtgcttttccccgttgattccgaagaagctcgcttcaaacgtttctttacctttgagaaaagacccttcaattgtccaatattcttccggtataaaatcgttgatttctttctcccggtcaatgataaggcggagcgcaacagattggacacgtcccgcactcaagcctttttttacttttttccataatatcggactgattttgtaccctacaaggcggtccagaattcttctcgcctgctgggcgtcgacaagatccatattgatcatgcgcggatgcttaaatgattctttgatcgcatcttttgtaatttcattaaatacgacgcggcagtcggaattcaggtccaaatcaaggctgtgcgccaaatgccacgcaatcgcttccccttccctgtcggggtcggctgcgagataaactttttttgcctttttggcggccgtttttaattctttcaacacggggcctttcccgcggatcgtaatgtattttggttcaaagttctgctcgatgtcaacgcccatctggcttttcggcaaatctctgacgtgccccatcgaggcttttactttatatttttttcctaagtatcgctcaatcgtttttgcctttgcaggcgattccacgatgactaagtattcggacataacattatccccctcaagaggtgttctctctcttttcaatttagcctttttattgtattcagcataatcgtcgtttatatagtcattatttttacgaaaagtgtctgatttaatccttctatatgttgaacgccgattaaagcgtttaaacttgaaatcctcactattattaaatattacaatacggtttgtcaaacgataattctaaacaggctctgtatattgagcgtttgaaggcggaagttcgttcaaaatgtcttcaatagttaatacgagtttcgccccttcctggatcagccttgaaggaccgaaagagttggcatcaaagatcggacccggcacggcgaacacctcccgcccctgctcaagggcttggtatgctgtaatgagcgatccgctcttttccttgccttggacgacaacgattccttccgttaatccgctgatcagccgatttcgcatgggaaaatgccatttttgcggtttaatgtgaggagggtgctctgataccagcaggtggctttcggccatttgtccggcgagctggcgatgttcacggggatatatgctgttgaatccgcccgcgataacgccgattgtccttccctttgaacggatgctctcctgatgggcgagaccgtcaattccttttgcaagaccgctgacgatcgtccagctgtttttgcaaagctccctgacaagctggaccgcagctctttttccgtataatgacgggcagcgagttccgacgattccgatcagtctttgttcatggagaagttttttgtttccttttaaaaaaaggacgggaggcgggtcatgaatggttttcaggctggctggataatcaggggaagatatggcggtcatgcggacgccggccgcctcgtaagaacggatgagccgtttaacattagacagttcttgttccgccagttttcgtatggagcacaagtctgatctttttaatgaaagcttcgttaaaagatggtttttttcgcccgtaagagacaaggaagggtcctgcttccaccacttggtcagcagagaaggggagagtgtgccgcgaaggcggagcaatatcaaaagctcgctgctgtcgttcattcaaaaacctccaaaaattttcaaaacaaaacaatctgaaagtactaaacgatataaccagttatgaaaaagcaggaatagaccaatcggactattcccgctctttttaatcatcagtgtgttttacacgtttcgtaaagacctttttccttcagcactttaatcaatgtttctcccatgacagaaggcgtttcagccacttcgattccgcaggcattcatcgttttgatcttttcgtccgccgtgccttttcctccggaaatgatggcgcccgcatgccccatgcgcttgcccggaggcgctgtctttcctccgatgaaaccgacgacaggtttggtcatgttggctttcacccattcagccgcttcctcttcagctgttccgccgatttcgccgatcatgatcaccgcatgtgtatcaggatcttcattaaaagccttcagcacatcgatgaagtttgtgccgttgacggggtctccgccgatgcccactgctgtcgactggccgactcctgcttcggaaagctgatgaaccgcttcatatgtaagggttcctgaacgcgacacaacgccgacatggccttttttatggatatatccgggcatgatcccgattttgcattcctcaggcgtaatgactcccgggcagttcggaccgatgagtctcgttttcttgccttccatataccttttgacttttaccatatcaagcaccggaatatgctcagtaatgcagatgacaagatcaagctcagcatctgtcgcttccataatcgcatcggccgcaaaagccgcaggaacgtaaatgacagacgcatttgccccggtctgctttacagcctcttcgaccgtattgaacacaggcaccccttcgacctctgttccgcctttgcccggtgtgactccgccgacaattttcgttccgtattcaagcatctgctttgtgtgaaacaaagcggttgaacccgttatcccctgaacaatgacttttgtgtctttattaataaatacactcattttggtcccctgcctttcttacttcactaaggatacgattttctgcgcgccgtcagccattgattccgcagacgtaatattgagtcctgaatcatcgaggatcttcttgccgagatcgacattggtgccttcaaggcgaacgacaagcggcaatgtcagaccgacttgttttgtcgcttcaacaacgccttctgcaatgacgtcgcatttcatgatgccgccgaaaatattgacaaagatccctttgacgttttgatcagacaaaatgatcttgaacgcttccgttaccttttcggctgtcgcgccgcctccaacgtcaaggaagttggccggttcccctccgtagtgcttgataatgtccatggtcgacatcgcaagccccgctccgttgaccatgcagccgatgtttccatcgagcgaaatatagcttaaatcatacttggatgcttcgatttccttcggatcttcttcatcgagatctctgtactccaagatgtctttttgtctgtatagcgcattgctgtcaaagttcagcttggcgtcaagggccatgacttttccgtcccctgtgacgacgagcggattgatttcagcaatggaacagtctttttcagtaaacgccttgtacagccccatcataaacttaacggcctggccgacaagctctttcggaatattgatggcgaaggcgatttttctcgcctggtagctctgcagtccgacagccggatcgatcacttctttgacgattttttccggtgttttttcagcgacttcttcaatttccgtgccgccttcttcagaggccatcagcacgatgcgtgaagtcgccctgtcgagaactaggccgacatagtattcttttttgatatcgcagccttcttcaataagtaagcgttttatttgttggccgtcgggacccgtctggtgagtgacaagcgtctttcccaacaattcttccgcataggctttgacttcttcttttgattttgcaattttaaccccgccagctttaccgcgtccgccggcgtgaatttgagctttcacgacataaaccgagctggacagcgcttccgctgctttgaccgcttcatctgctgtaaatgccactttaccttccggaacagccactccgtattttctgagtacttctttcccttggtactcatggatattcattttcccatcctcctaacttatgtagcaaaaataaaaatagactgcgctttcattttatataatcatagatcgattgtctaggtttcgatgagaaatcgtaaaatccttctaaacattcacacttttattttattaaaaatataaaattaatagaggaaacggctttttttcaaaagtcattccctctttttcattttttcatcaagcgtatagacgaatgaaaagatctcggcgacgatctcgtaaagcgcttcaggaatgtggtcgtcaagctccaagtggcgcatcaattcgacaagcgtcgcatcttcctgaatcggaacaccggctttctgcgcctcttcaatgatcttctccgccgtgtatcccgaccctttggcaaccaccttcggcgccttgtccttcatttcatcgtagtgaagcgcaacagctcttcttaatggaacagattccttcatattttcacatccactgcgctctctgtaatttgttcaaaacgggactccaaaaacggagcgagcttcatgttttcccgtttttttgctgagacgcctgacaagctgtagcccagctctttcaggttttcctttaaagccgggaccagcggttcaatcaaagactccaaatcgaactttgtttcaattgtaaccgtcatgacgttttgctggatcaaacaatcgatcaccgtctcttcaagggcttccaactgaaggtaaaacatgaggcggcactgggaagggtcgatttttccgtcgtcttttttctgcccttttaagaaaacgttcaaatcctggacgccgttctttgaaaacagagggtacgacagaaaaagctggctctgggcaggctgatcattctgcaaaaacagctgtccgtttaaacggtgaaagatttggtccgcttcctgttttacaggagccggaagatcggaagcatgcctcatttcattcagcacgagctttaaagattgcaggccctgctctttgagaacggcgccgttttccatcgctctcaacaatgagagctcatctctgacgcctaaaacatctttgatcttgaggagaacggataatacatcggctttattcgtcaatgcaggcgctgtttctttcatgatatgctgcaaaagttccgtctcttttggcgtgaatccttccagaacggccggagcttgtccgagagctccgcgcgattcaagcgctttgatgacgcctgccgcttctcttgcaatatgcgtcccgttcgtttcggcttgtgccgccaatttagcgaacacgtctttagctgctgcgatttgcggattgtgctgggctgcttttgcttcctgtccgtatgcgccgccagcgtctgctttttgcggaggttttccgccttctgactgaacctgcggctttaatggcagaacggcctgcagttctcctttttccagcgatctgatgtgttccgcaagcttttgaatcagcctttcggcatgcacctcagtctccgcttgtaaaactggcaaaagcgcctgtttcagcttttccatgcctggggatggctgagcggcgttcgcgatcatatcaagcgttctcgcaatctgctcattgagcggaacggggcttttgacggccataatcgaatcgagcacgccggggtggacgggaagttcgcgtttaagagcgaacatgacggcatcggcgcctttttgggcatcggacttcggcagattttcaagccacttgatggcggctcttaaatcgttttccctgatcggctgctgctccttcagcaacgctccgaccagaaagacggcttccttcgtccgcttcagagaaagcccgttcaacagcttaaaggcggcatcctgcacggtcttcgggtttttgtcaaacgcttcaacgacctgaaggcggcctgtcgcttcatccggcttcttttcatacgaaaaccagtaatgagcgcccgctttcaggggtgcctcaagcttcccctgccatttcgtattgccgatttgtatttcggcgaactgctcgctgataaagcggagcactttgccgagcatcagccttttctgatccgtctccgttccgctgatccgctggagagaatccgcttgttcaaattgttttcttaagctgttatgtacatcgttcagcatcatcaaagtcattcttcctccggaacgttattcatgtgctttaacaggggcgaacgatcttcggtgtatcggcgacgggccgtatttcgccagggcattcagatgctccttcgttccgtagcctttatgcttttcaaacccgtagagaggatacttttcagcgtattcatccatcagcctgtccctcgtcacctttgcgatgcatgcgcctgctgctatcgaggcgcttttggcatcccctttaataatcgatgactgctctgtatcgaccgcaagcgacatggcgtcgatcagaagataatccggtgcgacgtccagcgcttggaccgctttcagcatcgccgctttggaggcttcataaatattcagctcatcgatctcatgggcgtccgcgatcccgacgccgactgctgcggcttcttccattatgtatgaataatagtcttctcttttttgctttgacagttttttcgaatctgtcagccctaatatttcacaatcttctttgaggatgacagcggcggcgacaaccggccctgcgagaggccctctgcccgcctcgtcgattccggcgatatattgatagccccgcgctctcagcgaccgttcaaaagacgtcatcgcctgccactcttcccgcatggccgaaagcctttcatttttcttcagccaggcgtcgacgagcgcttgaacgctttttcgctcatcatttttgcactgctctataaaagggtccttttcatcgctcaccgattgaagatgttctttaatttctttgacggttaatgttttcactttctcttctcccctaatgttcttatcggcgcatcttctgcaaaaataaaggcccgctcttttaaaagcgcgcctttttacatatcctccggcttttcaaaagaaagcgggccgaatttttcggtgcggatatcgcggatgatgacttctgtcgtcttgtcgtaattgatctcgcctccggccatgaggcagccgcgtttttttccgatctcatcaaaaagcgctgcaatttcttcaggaatctcctccaggtcatagcgcttttttaagcgttcggggtaattctcttccaaaaagcgcaaaccgtagacggcgacatcctgcaagttgataatcgaatctttaattgcgcctgttgccgcgagcctcagcccgacaagctcgtcctcaaacttcggccataaaatccccggtgtatcgagaagctccagctcttttccgaccttcacccactgctgtgcagtcgttactccgggtctgtcgcccgttttggcgatgttttttttcgcaagccggttgatcaaggtcgatttgccgacgtttggaataccgacgatcaatgctctgatcgcgcgcggctttacaccttttgctttcattttatcaaacttttctttcagcagctcttttgatgcaggaagaatttgattgagcccctgtccgttgaccgagttgatggcgagggtaggaattccgtctttttcaaagtgctgcttccaagcctttgtcacggaggagtccgctttatccgccttgttgagcagcatgattctcggcttgttctttaaaatgtcttcgatcatcgggtttcttgaagacatcggaattctggcgtcgaccagttcgtatacaatgtcgatcagcttgagtttttccgttacttcccgcctcgctttggccatatgcccggggaaccattggatcaccatttgtctgccacctactttctgttattgctattcttttaatggtgcgatgcatttatacttgtttgacaaaaaaagagcttgttatggttaacaagctcttttcgttcgttatcattatcgtctgatttctttaatacgagccgcttttccacgaagttcgcgcaagtaataaagtttcgcacggcgtactttaccatgacggacaacttcgattttcgcgattttcggtgtgtgcaatgggaatgtacgctcaactccgacaccgtaagaaatcttacgaactgtgaaagtttcgctgattccgccaccacgacgcttaatcacgacaccttcaaaaacctggatacgctcacggttaccctcgacaactttaacgtgtacacgtaaagtatcaccaggacggaacgcaggcaaatcagtgcgcaattgttcttttgtgatttcttcaatcaatttttgcatcgtcttcaactccttccaacagatgctcttgcgcgagttaaccggcacagcggaacatcgttttcaaacttaaacgagcgttcccgttcaagtcacaagtagtatcataccacacctttttcccgggcgcaatagaatctaccggtttttccattcagaaatccactttcgctcttcttctgacaaaggatagttttccagaaggtcgggacgccttaaaaatgtgcgcctgagagactccttccgccgccattctttgatcttcgcatggttcccggatgtcagaacgtccggcaccttcaagcctttataatctgccggccgcgtgtaatgagggtgttcaagaagccctgtgctgaaagagtcttcaaggtgcgattcttccttgccgagcacgcccggcaaaagccgcacaacgctgtctgcgatcatcatcgccggcagctctccccctgtcaaaacgaaatctccgatcgaaatctcgtctgtagacaggtgctccctgatccgttcatcatacccttcataatggccgcaaatgaacattaaatgctcttcccgcgccagttcttccgccttctgctgggtatagcgttcaccctgggggcagacgaggatgattctcggagaccctccggcttcagccgtcagcttttcgaccgcgtcaaagacgggctgcggtttcagcaccattccggctccgccgccgtatggataatcgtcaacggtttgatgcttgttgtcggaataggcccgaaagttcaccacgcgaaaacggacagcgtccttgtcctgagctttttgcaggatcgacgagccgagcacgccttcaaacatttccggaaaaagcgttaaaaaatcgattttcattcgtcaagtaatccttccatgatatgaatcttgatcgttttatccgctacgttaatctctttgacaacggcgtcaatataagggatgagcgcgtctttctttcccggtctggccacgacccagacatcgttggcgcccggcgttaaaatttctttcaccttgccgattaaatccccgtcttccgagaaaacatcgcagccgatgatttcgtgaaagtagtattcgtcttccgccaactggcttaattggtcttcgggaactttaatcaaggcattctttaatttttcggcttcggtgagcgtttcaacctctttaaactgcaaaaggtggaactgtttgtgaagcctgtgggcgctgacggtcacctggacaggctcgtcttttccttccagaaacaagtagagcgcgtttccgggcttgtaccgctcctcaggaaaatcggttcttgaaatgacgcggacttcgccttttaccccatgagtattaacaattttccctacattaaaccattgtttcagcatttcttcacctcggacgaatttcaatgacgatcccgtctttaatcacgattgtttttcccgccgtcatatcatgccaattatccccgacttcaatgtccattaaagcgtcgatttctttttcctttacttcgctgccaagcggcagtgtgtggatttgattgatttgaaaaacgatcattttaatcttgtcctgtcgtttttcaatttcttttttaaatgattcagtcgccgccggattgtggtgttccttttcgtgtttcctgagctgaaaatagagctggttgcattcgcgctcaaggatttcctttctttcttcaaaagaagccagcagcttttttttgctgttttcagtcaaaacctgcatgacggtaacacgttggataatttgcatggcatcatcacctactgtcccgtgatttttcctttccctgaaatccggcagcctggcataagctgacgatcggaatcgttcatctgtttctatttttcttacatgttaaaaaagggggaggttttcaccctctccccttagtctgcgatctcaagttgaactttcttagaagactgtgcgcctgccgcaaatacgacagagcgtatcgctcttgcagtgcgcccttttttgccgatgatcttgccggtatcctctctgttgacagacaggcggaacataatccgctctggattttcctctttgaaaacctgaacatcatccgggtgatccacaagcggcttgaccagtgatacaatcagctcttccaagtgcagatcactcattatttgctttgtttagcgttgtggaatttttccataatgccttcttttgagaacaggttgcgaaccgtgtcagacggtttagctcctgtttgaagccatttaagcgcaagctcttcgtcgattttgacttccgctggttttgcaagcgggttgtaagttccgactgtttcgatgaagcggccgtcacgcggtgaacgagaatctgctacaacaatacgatagaaaggagattttttagctcccatacgttttaaacgaatttttactgccattttactagcacctccgaaaatatttcaacaagatagtatattaacaatgataaaagtgtttgtaaagtgttttttcttaacaacgtttttatcatctgaaaacaggtttacatgaagggcagtttaaacccttttttcttgccttttgtcatgtttgtcatctgtttcatcatttttttcatttcttcaaattgctttaaaagacggttgacttcctggacggatgtcccgcttcctttagcaatccgtttgcgcctgcttgcattgatgatctcaggctgctctttttccttcccggtcatcgacttgatgatcgcttcgatatggctgagctgtttttcatcaaccttcacgttttttaagcctttcattttgcctgcgccgggcatcatttgaatcaggtcttcaagcggccccatattgcggacctgtccgagctgttccaaaaagtcgtcgagcgtaaagctcatatttttcattttttgctcgagttccttcgccttttcttcgtctacgttggcctgggctttctcgataagggtgagcacatcgcccattccgagtatccgcgaagccatccgttcaggatgaaacggctccagcgcatcaagcttttcgcccattccggcgaatttgatcggcgtgtttgtcacggcgcggattgacaaggccgctccgcctctagtatcgccgtcaagcttcgtcaagatgacacctgtcacaccgagctgttcgttaaagcttttggcaacattgaccgcgtcttgacccgtcatggagtcaacgacaaggaaaatctcttccggctgagcggtttcttttacctgctcaagctcatccatcagctcttcatcaatatgaaggcgtcccgccgtatcgatgagaacgtagtcgtgatgatcttctttcgccttttcgatggcctgcttggcaatctccaccggactgaccttgtcacccagtgaaaataccggcatatcgagctgcttgccgagcgtttccagctgtttgatcgccgccgggcggtagatgtctgctgccacgagcagcggattgcggttatgttttttgcgaagcaggttggcaagctttccagtcgacgtcgttttaccggccccttgcagaccgaccatcatgatgacggtcggcggacgctttgcagcggcaatcttgctttcctcgccgcccatcagctccgtcagctcttcttttaccactttaatgacctgctgtccgggcgtcaggcttttcataacgtcttgtccgacagctcgttcgcttacctttttcacaaaatctttcacgactttaaaattgacgtccgcttcaaggagcgctaaacggacttcgcgcatcatctctttgacgtcttgctccgttacttttccttttccgcggatttttgagatcgtttgctgcagtcggtcggctaatccttcgaatgccatattaagtgccgcctcctaatctaatttctcaagcgcatcaatcagggactccgcctcaggctgaccgtcagtcagctttctcagcgcttcaaaaatctttttgcgctcttgaaattttttaaacaaaagtagcttttcttcatattgctcaagcatggcttcggtccgtttgatattgtcatagaccgcctgccttgagacatgatattcttcagctatttcgccaagggagaaatcgtctaagtagtaaagcgacatgtagcttttttgttttgatgtcaacaacgactgatagaaatcgaataagtaattcattctcgttgttttttcaagcgtcatgagactctcccctttgttaagtcaaatccctttacgatacactagtttacgctgaaatatttgatctgtcaagtttttatcttgtcataccggacggcaaaaaagaaaacccccgcaaaggggttttccgcgcctactcttctttctcgatcagatcggaaaacaggccgtatacatatgactctgcttcaaacggctgcaggtcatccattttttcccccagcccgacaaacttgaccggaatctgcagctcatggcggatggcgaggacgatgccgccttttgccgttccgtcgagcttcgtcagcacgatgcctgagacatcagtcgctttggaaaattcgcgcgcctgtgtcattgcgttctgccctgtcgtcgcatccagtacgagcagcacttcatgaggcgcatcaggcacttcgcgctgaatcacgcgctttaccttttctagctctttcattaagttcactttattttgcaggcgtcctgccgtgtcgcaaagcaggacatcggcgccgcgcgctttcgcggcttgaacggcgtcatagataacagccgcaggatccgagccttccgcctgtttgacgacatgcgcgccgacgcgctctccccacacttcaatctggtcgatcgcgccggccctgaatgtatctccggcagcaagaacgacatttttgccttctttaatgaattgatgggcaagcttgccgatcgtcgtcgttttgccgacgccgttgacgccgacgaataaaatgatgtttaggcggccgtcttcgacgcggagctctgatgcttcctgctccccgccttcatagatttcaacgagcttttcagaaatgacggactgcacctctttcgggtcctgaatatttcttcgcttgacctcgctcttcagctcgtcaatcagctccataacagtcgcaacgccgacatcagcgccgatcagaacctcttcaagctcttcaaaaaaatcctcgtccactttccggtagcgggagacaagctcattgacccgctcctgaaacgtatttctcgttttcgccaggccttctttaaatttgcctgagaccgaatcggtctgctgtgtgattttttctttcagttttttaaaaaagctcatgtcctgtaacctcgctttattgaactaattcttttgtttcttcaagcttgactgagaccagcttggaaacgcctgattcctgcatcgtcacgccgtaaagaacatcggcttcttccattgttcctttccggtgggtgatgacgatgaactgggtttcatggctgtattttttcaagtattgggcaaagcggaacacgttcgcttcatcaagggccgcctcgacttcatccagcacgcagaacggaaccggtctgactttgaggatcgaaaacaggagcgcgatcgccgtcaaggcccgttccccgccggaaagcaggctcaggttctgcagctttttgcccggaggctgggcgataatatcgacgcccgattggagcaggtcattcggatctgtcagcttgagctcggctcttccgccgccgaacagcgcccggaagacgtcttcaaaatgggagctgatctgcgcaaatgtttccgcaaaacgcttcgtcatttcctcatccatttcctcgatgaccttaaagagcgtatttttcgcttcgagcaggtcgtctttctgctctgaaaggaagaggtagcgttcattgaccctttcgaattcctcaatgctgccaaggttcaccgttcccagctcttcgatcgcaagcttgatcagcttgacgcgcttcctcgcttcttcaggggaaagctccaaaggatatttttcccttgccccttcaaatgaaaggccgtactcttcccgcaggaaagagagcaggttgtcgagctcgacttccatgcggccgagcttgacttcttcatcttttaagagaccggccatctgcttatactggcgcttcatttctttcagttcgagctcttcggtttcaaggcctttttgcagcttcatccgctgttctcttcttgaggcgatgagctctgcggttttatttttatcgttcagcttctttttcgcagcttcttcaagtttttcctcaccggaagaattggaggacatctctgtcgttaagaaagaaagatcctcttcggccaccttgagcgcttccgcattctcggcatactcttcttcaagccttgcgagcttttcccgttcgtttgcacacgactgttcggttttcgccagcaccactttcaaatcggtcagctcgctttgcaacgcttctttcgtcgaggtctgcgtctgtttccgctccgtcatggcttcgatttcggaatcaaggcgctgcagctcgccggcgatcgatgcgagcttttcttcaagctcttctttacgccgcttcttgtcttcgtccccttcaagcagagccgatttttcctggtcatagagctccaaatggctgttgacgtttttctcggcgatttcgagttcgtacagacggcctttgatttcctgctgctcggatcttaggcgttctccgtcctcgcgaagtgactgtagcttggcatcaagctcctgaatggtctgcttcagggctttcacttctttttcgagcaattcggttttttcttccatctcggcgaggcgttttgtctgggcttccagttccctgtttcgtcccagaagcgagctgctttttttcttgacagctcctcccgtcatggaaccgcccggattgacgacatccccttcaagggtgacgatccggtatctgtggccgagccgcttggcaaggtcgttggcgccctttaaatgctcggtgatcagcacggtgccgagcagattttgcacgacgctccggtaggccggatcaaatgaaacaagctcgctggcgatgccgatgaacgacgggttttctttcgccgtctcgatgtctctcggctggatgcggcgctctttgatgacggaaagcgggaggaaggtcgcccttccgaacgaatgctttttcaaatattgaatcgcccgtctggcggcgtcttcatcttctgtgacaacatgctgtgctgttgcgccgagcgcgatttcgatcgctgtttcataccgctcgtccgtctttaacagctctgcaatcgcgccgcgaattcccggaagctcgctcttggcctttaatacttctttgacgccttgataaaaccccgaaaagtcctcctgcatcgcttcaagcatttcctttttagagcgcgcctgctgaacgtattgataagcctggtaaagggcggattcctttttttcgtactggctttttttctgttcatagcttttttgcgcgtccctgaatgcttgaatctggctgtgaagacgctcgtccacgaggctgaattcgtgttcggttttcatcttttggtcggcgatttccttccgctcgcttaaatatttttcattgttttgtgcgagccgtttctgctgtgccgcagattgggtcatttggtcttcaagaaattgaagctcgttgcggacggaagcctgttcgttcaacagctcgaaataatcgcttttcagctgttcgatttcttcctctacattttcgctgtatccggataaagcctgatttttttctttcacctgtcgggcaagctcttttgcttcagtctcgagcttttcaaacacaagcttctgcgcggcgattttctctttcagggttcgctctttttcactgcgctggacgatcgcttcttcaagctgagctctgttttgcgtggcgttttttttgcgttccttcagcacttctttccggccttcaagcttctccagttcctcgcttgtcaaaagcagcacttgctgaagctcatcgaccgattcgtcgagcgcttgaattttgtctcttgcctcttcgattttggcttcttttgcctggatggccgcagaagaggacatttcttcgtctttcgccttttcgactttttgctgaagggcttcccattttccgtgaagctcttcgatgtcatacgccgttaacgcgatttcgattttttcaagctcatccttcttttcaaggtagtctttggcgatcgatgcctgcactttcagcggctccacctgtccctcgagctcgtggaggatgtcttcgacccggttcaaattgtcctgtgtctcaaacagcttgttttcggcttttttctttctcgttttgtattttaatacgccggccgcttcttcgaagatgcttctccgctcttcagccttgctgcttaaaatctcttcgactttgccttggctgatgatggaaaacgcttcttttccaagccctgaatccataaaaagatcgatgatatctttcaggcggcacggctggttgttgatgagaaattcgctttcccccgatctgtagactcttctcgtcacactgacttcgtgaaaatcgatcggcaaaaagcggtcatcgttgtcaagcgtcagcgtcacttcggcaaggttcagctttttccgcgagtcgctgccggcaaaaatgatatcttccatcttgccgcccctgagcgatttggcggactgttcaccgagcacccagcggatcgcgtcggtgatgttgctttttccgctgccgttcgggccgacgacggctgtcacgccttttacaaaatctacagaaattcgttctgcaaacgatttaaatcctatcacgtctaaacgtttgaggaacatggtgatcctccttatgtattaaagtattacaattctatcataaccctatggaaaaggctcaaaatacattgaaatccccctggtttttgcaagggggatttattgtttcatatggtgtttttgcagcttcgcgagcgcttcttgagcggcatgctgttcagcttcttttttggaacggccgcttcccaccccaagtacttctccttttagcgatacatttgcttcaaattcgcggttgtgcgccggtcctttttcctgaaggattttatactccagtatgcctcgcccgtcgcgctgtacaaattcctgcagctggcttttaaaatccatcacatgagaaaaagcaccatcgtcgattttagggaaaacgtacgctttcagaaaagtcacgacggcttcgagcccctgatccagatagagcgcaccgataaaagcttcaaacacatcggctaaaagcgccggacgctttcttcctccagtcatttcctctccttttcccaatagaacaagctctccgaaagaaagctcatgggccagggaaaccaaagaaggctcgcatacgatcgccgctctcaatttcgtcaaatcaccctcgctcatcgccgggtatttggcgtataaaaattgagaaatcgtcagttccaaaacggcgtctcctaaaaattcaagcctctcattatcttcatatggcttctttcgatgctcattcacataagatgaatgtgtaaacgcttgatataaaagcttctcgttttgaaattgaaccgaaatccgttcctgaaactttttaaactgctccgcttttttttgaaacatttttttgtctctgaaatgtgaatgttttgacatagcaacctccatatgggcacatcaagttcacctcacctcctatgaaaaggcaggttcgtttatcattgggcaaaacattaaaattaaagccgcatttataaagggataaagccccgtctttaaacgggactttaaatgagcttactgcttactatttatgtagttcacagcgtcaccgactgttgcaatcttttcagcatcttcgtcagaaatctccatatcaaactcgtcttcaagttccatgacaagctcaactacatccagggaatcagcgcctaaatcctctttaaaagaagcttcaagagtgacgtcagcttcatccacgccgaggcggtctacgatgatttttgttacacgctctaatgcgtctgccatagctattcacctcccctcaagtattatagttgattcgtttttaaaaaaccagagataattcaatttttgatttcgtttaaaccatagccattccgccgttgatgttcagcgtctggccggtcatgtagctcgcatggtcagatgcgaggaaaacaacggcgctgctgatgtcagacggctcgccgaaccgtgcaagcggaatctgcttcagcatttcgtcttgaatgtcttttgtcagcttgtccgtcatttccgtcgaaatgaatcccggagcgatcgcattcacagtgatgtttcttgacgccagttcttttgccagcgttttcgtcaagccgatcacgcctgatttagccgcgacatagttggcctgcccggcgttaccgacgacgcctacaaccgaggtgatattgatgatccggccgcttctttgtttcatcatctgtcttgtcacagcttttgaacaattgaacacaccttttaagtttatgttaatgacgtcgtcccattcatcttctttcattctcatgaacagattgtctttagtaatgcccgcattgttgacaaggatgtcaagcgtgccgaagcgtccgaccgcttccttcatcatcgcctgaacctcatccgcattggaaacgtccgctttaaaagcaaacgcatcgcggccgagcgctttgatttcgtctacgacttcgttcgctttcgcttcatttcccgcgtagttgacgacgacatttgctccgtttttcgccaggtccagggcgatcgcgcggccgatccctcttgaggctcctgtcacaacggctgttttattttccagcattttcgttttcctccttcaacgtttgaacggcaagttcaattgtgttcgggtctgatacagcaatcgttttgactctgcggttcactttcttcacaagccctgacaaaacctttccgggaccgatttcaatgaaggtcgtgacgccttcgtcaatcaggcggctgattgtttcttcaaagcgtacaggggaatacagctgttcaatcagtttattcttaatgtcgtctttatccgttacaaagtcggccgttacgttggagacgaccggaatggctgcgtcgttgatcgtgcacgcatcaagaacttcacgaagcttatcagctgccggcttcatcagctcagaatggaacggcccgctgacttcgagaggaatcgcgcgttttgcgcccttttctttcgcaagctctgaagcgagctccacgcctttagctgttcccgagatgacgatttgcccagggcagttcaaattggcgagctgaacaaggtttccttcttcggaaattttgtccgtcacttctttcagcgcctggctgtccatgccgagaatggccgccatcgcgccttctcccgccggcacggcttcattcatgaattcgccgcgctttctgacggcataaaccgcatctttaaacgacaaggcgccggcagcgaccaatgcgctgtattcgccgaggctgtgacctgccgcatagtcggctttaatgccgtattccttcagtttttcaagcgctgcgatgctcgccgttaaaaggcttggctgcgcgttgtatgtaagcgtcagttcctttgcatccccttcaaacatgagggtgctcagttttgtttcaagcgtttgatccgcttcttcaaaaatcttcttcgcattcggttctttttcatacaattcgtgtcccatgccgatatgctgcgaaccttggcccgggaatagaaaagcaatcttgcccatgtgttaaaacctccagactattcatctgctttttgttgaattttttcttcgataaatgccgcgacattttggctgaccatctctctggcctggcggatcgcgtgataaacggcgcgtccgtcagatgatccgtgcgctttgatgacgggcgcctttaagccgaacaatccggctccgccgtattcagagtaatccattttcgttttcatttctttcagcttcggcttcagtgcagaagcggcgagcttcgccgtgaagctcgaagtcagcgtcgttctcagcattttaaaaatggacagcgccgcgccctcgaccgttttcaaggcaacgttaccggtaaagccgtctgtgacgatgacatcagcgactccgtccagcatatcgcgggcttccacattgccgatgaaattcaaatcggtttccttcaatttttgaaaggtctgcttggcaagctcatttccttttttatcttcggttccgacgttcaaaagtccgatgcgcggatttttgacgcccagcacctgttctccgtaaacagatcccataatggcgtattgaacgagatgttcgggcttggcgtccacattcgctccgacatcaagaaggagaaagccgtctccggagacggtcggcaatgtcggtgccaacgcaggcctttcaatcccttcaatccggccgacgataaagagcccggccgtcataagcgctccggtgtttccggcggaaatgcaggcatcagccctgccttcggcgacttctccggccatcagaaccatcgatgaattcttctttcttctgacggctctgactggctcgtctgtcgcttcgatgacttcttccgcgtgtttgacggtgatccgcccgtgttctgttaaatgggcggctattttttcccggtcgccgatcagcgtgatctcgaggtcttcaaaatcttcgaccgctttcatcacgccttcaataaccgctttgggagcattgtctcctcccatggcatctacagcaattttcatgacttacgcgccaccttctatgattgttttgaacgatacatgacaaattcgcctgaaaacacaggctcttcggcaacatagctgttcacttcaacaaccgttctgcctttatctttatcaagcttcacgactttcgcttttgcaacgacccgttcgccttgcttgacctgccttgtaaagcggatgtccgctttggccgtcaatgcgagctcatcgtcgatgagggcgacggcgagcgagttggcctgggcaaacaaatggtgccccctggcgatttgatttcggctgaaaacatgctcccttctgatctcaagaattgaaatcgcgtgctcatccagctccaaatcaatgatctcgccgatgacctcgtcaagcggcaatgacttgacttcatcttcaagagacttctcggcaacacttttgattctttctctcagttcaggtatggaaagttccaaacggtccaagcgaatcgtctgaatgctgacgttaaatttctccgctaactcctcgtccgtaataaacggggtcgtacgaatcgtctgctgcagcaattcttggcgttctctcttactttttctcatgttattaaacaccatccgcgcaattatgactaggtactaatagtagtatataatttcatagattggaatgcaatctttctttacccgccgacgataaattttagctggacttcagatcagctcagcttctctccgtccataaccccgctgttttgcaagtgttcccgcaggcttttatattcggcatccgtccagaacgcttttgaagagacaagttctgcagcgtctcttcttgccgtttccagcgcgcggtagtcgtgaaccatgtcggcgactttaaactccggcatcccgctctgtttcttgccgaaaaagtccccgggccctctgagttcaagatctttttcagaaagctcaaagccgtccgtcgtctcagacatgatgctcatgcgctcttttcccgtctcagatttcgggtctgccatcaggatgcaatacgactggtgatcgccccgtccgacccggccgcgaagctgatgcagctgggaaagaccgaaccggtcggcatcatagatcagcatgaccgtcgcattcggaacgtttaccccgacttcaacgacggttgtggaaacgagaatctggcattcgtttttgctgaactgcctcattacctgttctttctcgtcatttgacagctttccgtgcatgagaccgatctgccatcttcccctgaaggcatgagtcagcatgctgtgcacatcaattgcattttgaacgtcgagcttgtccgactcttcaatcaagggacagatcacatacgcctgtctgccttttttcagttctttatcgataaacgcgagaatccgttcgagcatgtcgtgctttacccaatacgtctcgatccgctttcgcccagccggcatttcatcgatgacggacacatccatttccccgaaaaccgtgatcgccagtgttctcggaatcggcgtcgccgtcataaacaagacatcgggatctttccctttgcttctcagtttttttctttgctcgacgccgaagcggtgctgttcatcggtgatcacgagcccgagctgtttaaagtggacatcgtcctgaataagggcgtgcgtccccaccaaaatatcaatttctccttcttttaatctttctaaaagctctcttctccttttccctttcacagagcttgttaaaagcgccacattgacgtcgtgctgctcaaagagggatacaagcgaatcggcgtgctgttccgccagtatttcggtcggcaccatcatcgccccctggaatccggaaagcagcgaggcgtatagcgcaatcgcggcgacggctgttttgcctgaaccgacgtctccttgcaaaagccgattcattttataccctgaagccatgtcccttaatatgtcgtcgagcgctttcgcctgcgcgtttgtcaaaggaaacggaaggcttttgacaaacgaattgacgtcttcgagccgaaaggtgtggctgattccgtcggacgcttcccgctcgaactttcgcaaagcctgcattttcagctgaaacagcaaaaattcctcatatacaaaacggcgccgcgcatgctttaaagcttccctcgactcgggcttgtgcatcgcctttaccgcctcctggtaagacagaagtttgtaggcggtccgaagcttttccggaagaggatcttcggcaaacggcaaatggctgcggacagcttcctgaatcaatttcctcatcgtctttacggtgatgttttctttgacggagtatacgggttcaatcgactgatcaccctggtgcggcccgtttttcagctcttgcaccatcacggattgtctgtgcttgtcccattttccggttacggtaacaatcgagccgatcgcaagcttttttttcaaataaggcctgttaaagcaaaccgctgtgatcaaatagttcccgaccaaaagccggaacgtgagacggctccgctttttcccgtaataggcaagagaaggctcgctgtgaaccttcccttccaccgtcactcgttcatcgtgtgccacatcttccaaatcgcgcaattcataatcgtcatatcggtacgggaagtagtttaaaagatcgagaaccgtatagattccgagctcgttcaacgttttttccgtttccgtcccgacgccttttataacagatatactaagttgcagattgtgttccacgtgcagctgacgctcctccgaatatttttttctccaattctttgcccgtcggtgttgcggcaagaccgccccggcctgtttccctcagtgccgtcggcatcgtctgtccgattttgtacatcgcatcgatcacttcatcgcatggaatgcggcttgtaatgccggcaagcgccatatcagccgcgaccatcgcattggctgcgcccatcgcgttccgcttcacacacggcacctcaacgagccctgcgacaggatcgcagactagaccgagtacgttttttaaagcgatggccatcgcttcggcgcactgttcaggggttccgcccgccatttcgacgatggcggcagccgccatgcccgaggccgatccgacttcagcctgacagcctccggcggctcccgaaatgctcgcattgttggcaacgacgaatccgaacgctcccgatgtaaataaaaagcggaccatctgctctttcgtcgggtgaagtttctcttttaccgcaaagagcgtccccgggacaacgccggccgatccggctgtcggcgttgcgcaaatcgttcccatcgcagcgttgacttcatttgtcgctaccgctttgctgacagcgtcaaggatgacatcccctgacagccctttgcccgatttaaggtaggcctgaagcttaacggcgtctccgcccgtcaatccggagtgcgatacgacgccctcaatgcctttttgaacagcgtcttccatgacagccaagttggcttccatctgcttgaatatatcttcccgcgtccggcctgtcacctcgatctcctgtgtgatcatgatttcagagatggacacgttcttttcctttgtcagttgaattaattctttcacatttcgaaacatatcgtctcaccctcctttttagtcagcgatctgggtcacctcaatgatgttcggcagcgctctcaattcatcaaaaacagccggatcaatcgtttgatcgacctcaatcgtcatgagcgcttcctggccgacgtctttgcgggcaacttccatatggccgatgttgattgcgaacttcgcaagcacattggctacgcctgcaatcgttccgtagcggtcgttatggacgactaaaatagcggggtgattacccgataatctgagttcgaagccgttcagctcaatgatctcgattttccctccgccgattgagatgcctgcgagttcaagggagccttcatcatcagagatgaggatgcgggctgtattgggatgcttcggtaccgcttcttcttcccggaactcgatggcgattcccttttcttcggctagacggatcgaatctttgattctttcatcaaatgtatcaaaatccaaaaggccgccgatgatcgcaacatctgttccatgtcctttatacgtttcggcaaaagaaccgtagagcgatacaataatttgtttcggctccctcccaaacacgcttctggcgactctgccgattctggccgcgccggccgtatgagaacttgacggtccgatcatgacgggcccgataatatcaaacacacttctgtacttcatccttatcccccttttacaaacagattcccccgctgtacggaggaaaaaaagccgttttttttagactaatcgatcatttcccaattggcaagcagacaacgtccgttgcgggctgaggctttaaaaaaagccaaaagaagagaagggcttttatcaacatgcccttctgcctttgattcgttattcgacagccagaatgtaggaatacagcggctgttttccgtcgtgcacttctacttcgacgtcttcgtacgtctcgctgatgtaggctgcgagttcttcggcctcttcttccggggcgtcttcccctttgatcacggtgacgatttcgctgtcttcatcgatcatgcctgcgatcagctttttcgctgctgttaactggtctgacgccgtctcaacgattttcccgtttaatatgcccataaaatcgccttttttaatatcgatgccgtcaatgtttgtgtctctgaccgcataggtgatctgtccgcttttcacctcgccgatcgcaccgagcatagcggcttcattctcgtccgctgaaagggccgggttgaatgcgagcagtgcggccattccttgaggaacggtcttcgtcgggatgacaattacatgttgtccggcaacatccgcggcctggttcgccgccatgacaatgtttgaattattcggcagaatcacgaccgtgtccgcattggcgtcttttatcgcctgaacgatgtcttccgtgctcggattcatcgtctggccgccttctatgacctttgtggcgccgatgctttcgaaaagctcggcaatcccttcacccatggccactgtgacgatgccgtacggctgtttatctgccggcgctttttctgccggtgctgtctcctgtttgttctggctgagaatcgcgctgtgctgttctctcatattttcgattttcatgttgattaagctgccgtatttttgcgcgtaagtcatgacttcccctggatattcggcatggatgtgcaccttggcgatattttcgtctgagacgacgagaagcgaatcaccgaagcggcttaaatcctggcggaacgcatcttcattaaagtttcttttgccgctgtcgagctttaccataaactccgtgcagtagccgaattcgatgtcttcagtattcatgtggctttgagcgtttttatggtgctcggcgctgacaaggtcatccaatgacggaagagctgccgctttatcagaaagcttttctccctttaaagaagcgagaaacccttcatacacgtaaagaagcccttttccgccgctgtcgacgacaccgacttcctttaaaaccggaagcagctcaggcgtccgctccaaagaagcctccgcttcatttacgacagcttccatcaccttgatgatattggtttcagtttgagcggcgagcactgctttttttgcggcatctttggcaaccgtcaagatcgtgccttcgaccggtttcatgacggccttgtaggcggtgtccactccggcctggaacgcggcggcaaattctttcgcgttaatttccgatttctgttcaatcgatttgccaaagcctctgaacagctgggataaaatgacgcccgagtttccccgcgcccccatcagaagcccccttgacaggctttgtgccactttgccgatattggcggtgtcgatttgctccacttctttcgcaccggatgtcatcgacagattcatgttcgttcccgtatctccgtccggaaccggaaatacgtttaacgcatcaactacatttgcgttttgagacagatggtgtgcgccgtacagaatcatatctgcaaaagcttttccatccagatttcgtatagacactcttgttttcctcctaactacgggttcgtcactcgtactccttgaacgtaaatatttacggaatccactgcaagacccactgtatggtcgagcgtatatttgacttttgtttgaacattatgtgccacttctgaaatttttgttccgtagctgacaatgatgtacatgtcaatatgaatacgatcctcttcctggcggacgatgacgcctcttgcaaagttttcttttctgaggatttcagtcagtccgtctttaatttggttcttggatgccatacctacgatcccgtagcagtcgatcgctgcgcctcctgcaaccatggcgaccacttcgtttgatatatcaatctgtccgtattttgttcggaattcaatggacacgttggttcctccttttcgagtctcgcttttgacctctggttataaatcattctactataaggaccttctttttaaaagaacaggcaggcttctctccaaacctaaccctacttatactacagcgcgttcattttttcaagatgtcaaggaatttttcttgaaagcagagcaatcaatagttgcaaacggttttcagctgtggtaaattattaaagtatctgaagcatcacaggtgatcaactgataaagaatgatgatgttttttttgatagttaggagggaaacaaatggcacgtaaatgcgttattacaggcagaaaatcacgttctggcaactctcgttctcacgcgatgaacgcttctaaacgcacatggggcgctaacgttcaaaaagtgcgcatccttgtgaacggcaagcctaaaaaagtatatgtatctgctcgagctttgaaatctggaaaagttgagcgtgtataagaaaaaataaacgcctgccaagagcgactgtacgctttaggcaggcgttttttcgttcttttgccatccggggacagccctttgacccgctccgcaaaaaaagcgcacccggcgcttcttagtctttgcgaaacgagccaagcatcgcccggacgattccccctaaaaacttcggtaatttgatggtgtaaaatttcattcccttccctcctcaaagagtccgcaaccgcatccaccttcaacatcggatcccaaacacaaagcgagcggaagcgccaggatatttaatcagtgcttcttatcattattaatatgccttctgaaaacgaaaaagcaccttgtgaatggatgagttcgttactaatacatagtgtcgaaccgagagcaatatgacacttatttaaagaatacttaaatccttcgagagaaaggttttttaccgtctccgcaaacggcaggaatgaaatatacggttttgtttgatcatgcatgacggtataggagcctgggggatgcatgctgatcgtattttggcggtcgatcatgacggtcttgacgttttgcttcatcgcggtataaagaaggtgcagattcccgagaaaatggtctgctctgcctcccgaaatgccgaacattctaataaatgaaggacgctgtccgacagcccagctcaacgcaaggtccaaatccgtctgatctttttccgcctgataaatatggaggcggggagcggccttttcaatcgcttttttttgctcgtctgtgatgctgtcaaaatccccgaatgcttcatcaggcacgatccccgcatccaaaagggtgacagcgcctctgtcaaccccgacccaaagcgcatccccggcctgatactgcagcaagtcgggaataagatgatcggggcctcccgctacaatattgatcgttttcatcgcattatcctttctgtgaacgccctaaaaaaagagcgcagctgcagaaagccggctctctttcatcaggaaaccttacccaagcgcaccttttatatcggaaatggcttttttgcggtctttttcgttataaacggcagatcctgcgacaagcaggttcgctcccgcttcaatacactgtcttgccgtatttttgttgacgccaccgtccacttcaatcagcagatcggcaagtcctttttgctcagccatctccttgacctgcctgattttcggcaggaccgaggaaataaacgactgtccgccgaagcccggattcaccgtcatcaataatacgagatcaaggtcttcaagcacatgctcgatctgctgcacaggggtatgcggattcaagacgactcccgctttgaccccttgctctttgatgagctggatcgtcctgtgaaggtgcgggcatgcttcaacatggacggacaaaatatcggcgcccgcttttgcaaaagcaggtatatagcggtcaggcgcttcgatcattaaatgaacgtcgagcggaagctcagtgatcgggcggacggcttccactacaagcggcccgatggtcaggttgggaacgaaatggccgtccatcacatcgatgtggatgaaatcggcgccgccttgttcaacatctcgaatttcctcccctagacgggcaaaatcggctgaaagaatagaaggagcaacatataccatatcttaatacctcggctttctatctttgatctctgttaaaaattcaacataatggttgtagcgatactgggcgatttcaccgttttccacggcgcgtttgacggcgcagttcggttcttttatatgcaggcatccgcggaacttgcattcggcgctcttttcgccgatttccaaaaatgtctgccctaaatcttcagcttcaataccggcaaactcaagcgagctgaagcccggggtgtccgcgacgagcccgccgtttatatcgatcagctccacatggcgcgtcgtatgttttccccttcccaagtgggcggaaatcccggcggttttcagttcaaggtcagggctgatcgcatttaaaagcgaagacttgcccacgccggactggccggcgaatacggtgattttatcctgaaaatgggggatgatgtcttcgatgcctcttccgcttttcattgatgtcaaatagacgctgtacccgatgttccggtagtcttcggcatattgatgaatctgctctttcagcgcgtcatcatccacaaggtccattttcgtgatgcatatgatcggcctaatatcacccgcctcaaccagcactaaaaaacgatccaaaagcgacgtgctgaatgtcggctcctttgccgaaaacacgagaaccgcctgatccacgttgctgatcggaggtctgaccaattcattgaatctgtctttaatctcgagaatgtagccttccttatcgttatcggcttggtagacaacatcgtcgccgacgagaggggttactttattttttctgaaaacccctcttcctctgcactgaatgacctgatcgccatccaatacatagtaaaatccacttaatgctttaatgattttgccctcaggcatatcgcacctcccttattcatcctcaggatattcaatcgtttttgacctgactactttatcgttgatcgttacttgataataccctttttggccgggcgcaatcctgaatttgatcgtccgctctgccggcgctgtgattttgaaattttcgtagacgtcagaaatgctgtgttcttcatcatcgatcgaaatttggacgttttgttcttcgcccgccgctcccggttcataaggaatatcaattttctcggtcaccgttttgacgggcttttgtttaggtccgagcgaaaacgtgacctcgactttgtctcccggcttgactgatgcccccgcctccggcttttgtttaatgacctgaccttccggcacgtcttcagaatgcgcctccttttcgacaaggacaagctgatggtcgtccaaatagcccgaagccgcctgtttgctgtatgtttttaaatcccttaaagtaatggcttccggaccgaggctgaccgttaatttgacctcgtcgtcggcggcaacgatttcggttccggctgcagggtcctgttcgatgatggttcccgcttcttcttcatcgtgcacttcttctgtcttgatgtttttaaagcctttttgctcaagaagcttcttggcggcatcgactttctggccgaccacatcatcgacttcagttttctctttgcctgagcttttatatagcttgacagttgaaccttccttcacgatatcgccggctgcagggtccgtcttcacgatcagcccttcttcaattttatcgtcggcaatgtcttcagcattcggatcaacttcaaatccttcgtcttcaagcttgatgacggcttcttcatattcaaggccggcaacatcgggaacggccacatctttcggaataaagagcgacggaaacaccgttaaagccaagacggctgacgcagccagaacgaaaaacaccgtcagcaatataagcggccatttctttctttttttcttcttgtttgcttttgcctgcttcttcttttctttttttgataatggagccgcttcctcttctccgccgccggattgcgagctgctcccgttttccggcagattcttgatgatcggaactgctttcgtcatctcatcatcggatggaatcgtgaagcgcttttcgttgagccggtccgggtcgaaagccgttttcaaatcgttttccatctcttcggccgcttcatagcgatggaatggatcttttgccatcgctttcaggacgacgttttctatgctttgcggcacggccgggttccatcttttcaccgacggcgtttctgattggagatgtttcagcgcgatgctgaccgccgattctccttcaaacggcatacgcgccgtcagcagctcgaaaagcacgatgccgagcgagtagatatcggattttttcgtcgataatccgcctctcgcctgttcgggcgacaaataatggacagagcccaaaaccgagttggtgtgcgtgatggtcgtcgagctgagcgccatggcgatgccgaaatcagtcactttaatgtggcccatatggtcgatcaaaatgttgtggggcttaatatcccggtggacaatctggttatcatgggcatgtgcgatggcggatacgatctgctccatgatttggaccgcttctttcggatgaagtgggcctgttcgatttatgtattctttcagggtcatcccctcgacatactccatcacgatataatagatgtcatcttcttctccgacatcataaatgctgacgatattcgggtggtcgaggcttgcagcggactgcgcttcccgtctgaaccgcctgataaaatcggcatcgtgaacgaagtcaaaccgcagcactttaatcgcgacttcacggtcgaggatgatgtccagcgctaaataaacgttcgccatccccccgccgccgatggcgcgtaggatttcgtaacgtccgctgatccgtctgccgattaacacttgtcttcaccttcttcaatttgagaaggaagttccaatagcgcgacggtgatattgtcttcgccgccgttgtcattggccagctgaacgagctgatccgctttctcctccgcagaagaaagagtcgtgagcatatccttcagtgtctcatcatccactttattcgtcagcccgtcagaacataatagcacttgatcacccggttcgatttcaaatgtgtgggcttctaccttcacttcgggatctgtgccgagagcttttgtgagcacgtttttccgcggatggtgttcagcatcctccttcgaaatccccccagtccgcacgagttcattgacaagcgagtgatcttccgtcagctgtatgaaacttccgccttgcaggagatagcagcggctgtctccgatatgggcgaccgtcagcgtttttcccgtgtataaagcgcagacgaccgttgtccccattccctggcactcttcgtgggccctcgaatggtcgaaaagtttttggttgacggctgaaatctgctctttcagccacgcttcgctttcagccggcgaagccgggacttcttcggtttcctcccaaatatcacgaagggctgagacggccatcctgctggcgacatcgccggccagatgacctcccattccatcgcagacaacagctaataccagtccgtttttttctgtgaaaatgccggcatcgtcttcattgtgctggcgtatttttcccctgtccgtttttaaggctgttttcaaccttgattcacctcgtctcttcctggcgctcctttgcacgaagctgtccgcaggcagcgtcaatatcatggccttgctctcttctgatcgtgacatttactccatgagactttaatgttttttcaaaggcgaaaatctgttctttcggtgttctgacatagtctcgttcaggtacatagttgaccggaatcaagttgacgtggcatttgattccttttagcaattcagccagctcttccgcgtgttcaacctgatcgttgacaccgccgaaaagcccgtattcaaacgtaacccttctgccggttttcttaatgtagtaatcgaccgctttcatcagatcgggcagcttgtaggctctgttgatcggcatcagccggcttctgatctcagtgttcggcgcgtgcagagaaatcgcaaagttgatctgcagcttttcgtctgcaaactcgtagattttcggaatgatcccgctcgttgatacggtgatatggcgcgctccgatattcagtcctttatcatggttgacgattttcaagaacgcaagcatttcctgaaaattatcgaacggctcgccgattcccataatgacgattgagctgacgcgttcatctgtttcatcaagcgcctgctgcactttgacaacctgtgcgacgatctctccggcttccaggttccgctttaagccgccgagggtcgatgcgcagaacgtacagccgatccggcagcccacctgtgtcgttacacaaacagaattgccatattcgtgccgcattaatacggtctcgatcgtgtagccgtcatgaagctcgaataaaaacttcattgttccatcttgggaagtctgtttgacggccgttttcagcgtcgttaatacgaaatgctcattcagctttgtccgcagctcttttgaaaggtttgtcatcttttcaaatgacgtgactctcttttcgtatagccattcgaatatttgcgcggcgcggaatggcttctcgccgttttccgatagccagcttttcagttcttctatttcaaaagaatagatggacggtctttctgtccgcaattcttttcttactttttgtttcgattccattattgtgatcccttctttctcatgctgcaaataaagaagccgtccgttccaaagtagtggggaaggatttgaatgcttccatccttgacatacggcgccgctttttcgggcagccgctcggcgagggtggggtccgcttcaaattcgtcgtgttcttccaaaaaagcatgcatgacttgttcattttcggtcgggtccattgtgcatgtgctgtaaaccaatgtcccgcctgttttcaataaaggtgcgatttcgtttaaaatcgcaagctgaatcccggcgagacgcgcgctgtcttcgggcgttttgctgtatttgagatccggttttctgcggatgacgccgaatcccgaacacggggcatcgacgaggatccggtcgaactgttccggttcgaagacttctccggcttttctggcatccagcgctcttgcttcaatgttggaaagtccaatccggcctgccgcttctttgatcagctttactttatgctgatgaaggtccagggagacgacctttcccgtatcttcgagcagttcgccgatatgagtggattttcctcccggagctgcgcatgcatccagcactgtttctccccgctcaggtccaagggctctcgctactagcattgagctttcatcttgtatggtgacttcgccttctttgaaaaaaggagtggacgcaatcgttcctttcagcagtttgacagcgtctttggacaagtcgccttcttccgcctcaatccccgcttcattcagacgggaaagaagcgtatcccggtcgtttttcagcctgttgacgcggatcgtctgcttcggcgggatcatatgaatccggcagatttgttctgccgcttcgaacccgtaggcatccgtccattctctgacaagccactccggatggcttgtctcaaccgcaaggcgttcaatcggatcggcaatatccgcaaaggaaggcactccttccctctgaacggagcgcagaacaccgttaacaaatgaagatattcctttatgcccgcgtcttttagcgatttcaacggcttcaaaaagagcggcccggtcagggattttctccaggtattccatctgatacagcgacattctcaacagatggatgacccagtctttcaccttttccggctttttaataaacggcttcagcatataatcaagcgccagcttattctgaagggtgccgtaaacgagttctgtcaaaaggcctctgtctttgtcgcttaaatcgttcgctttcatggcagactgaagcaaaagattgctgtatgcctgattctggtcaagcttaatcagtgcatcaagcgcgacttctctcacattatttttcatcgtcatgacccaatttcattccggcttgaagacccgctcccctgacaaaatcttcagccttcattctttttttgccggcaggctgcacttccgttaattttaacgcggtgtcatttccggttgcgacgacaatgccgtctttttcaacggtgacgatctcccccggctctgcctgttttaaggcttggcattttttcgcggcccatactttcagcgtctggccgtttaagaccgtgtatgcgacaggccaaggattcaagcctctgacttggttgtacaggacttcgccgggcttagaccagtcgatcagttcctgctcgcgtttaatgttcggcgcgtatgtcgctttctgttcatcctgtttttccggggttaccgaaccgtcaatgattctcggaaccgtttcggaaagaagcgcagctccggccttgctcagcttatcgtggagcgtgccgacattatctgtttcttcgatgtcaacttcaaccttggcgagcatatcgcctgcatccaatttttcgaccatgtacatgatcgtcacgcctgttttctctttgccttccagaatggcgtaatggatcggggctcctccgcgcagctccggcagaagagaggcatggacattgatacagccgtatttcggataatcgaggagctttttcggcaggatctgtccgaatgccgccgttacgattaaatcgggttcaagcgccaaaatcttgtccgtttccgcttcttccctcactttctcaggctggagcacgggaatgccgcggcgcagcgcttcctccttgacaggcggcggagtcatcaccttttttctgcctttcgggcggtcaggctgggtgacgacacccactacctcatagccgtcatcaatcaatgtgccgagcaccgggacggaaaaatccggcgttcccataaaaacgatccttgtcatccaatcatccttccatttcctcaagttcttccgcatcataatagcgcgttacttttgatgtgaataaaataccgtccaaatggtcgatttcgtgcagcagcgcacgcgccaaaaagccctcagcttcaatcgtaaacggtttcccgcggcggtcgaacgccttgacctttacataatcggaacgcttcacttcaccgtatagatcaggaaagctcaaacagccttcaggacccgtttgttcaccgctctcttcgatgacctccgggttgaccagttcaattcttcccgtgtcatcgccgatatcgacgactgccgctctttttgaaacgccgatttgcggagcggccagtccgactccgtccagctcaagcatcgtatcatacatattgtcgagtagtttctttaatgatttatcaaaagacgcaacgggttcggcaggggtctcaagaacctccgccggatacgttacgatcggttttactgccaatctaaaagccctccatcacactgttatttttacatcatcatatatggattcatgtcgatcgaaatcgccaattgcttttgttcaatgtctcgtttgtaatgatccataatgtttttaagcaacgatgtaagctggttttcctgtttgtattttatcacgcattgatagcgatatctatctttgatcctggcgatcggagatgcgacagggccgagaatcttcgcctcgcttgaaatgttcttttttaaataggtggcgattttttcagtcacgagtgccgccttcgtcacttcctcgtgcgatacgctgaccagcgccaaataataatatggaggataggcctgttcccttctgtgcagcatctcctgccggaagaatgtttcataatcatgcgtttttgtgagctgaatgctgtaatgggacggtgtgtacgtctgaatgatcaccttgcccggcttttcgtggcgccccgctcttccgctcacctgcgtcatcagctggaacgttttttcagcggctctgaaatcggggatgtgaagcatcgtatccgcgctcaagacaccgacgagcgtgacgttttcgaaatcgagccctttggcgatcatctgcgttccaagcaggatatcggcttcgcctctgccaaaggatgtgagcagcttttcatgcgctccctttcttgaggttgtatcgacatccatgcggatcacccttgcagccggcagaaccttcgtcaattcttcttcgacccgctgtgtgcctgtaccaaagtagcggatatgctcgcttccgcattcggggcagcttgacggcatgccggtttcatagccgcagtaatggcacttcagacgctgtccatacctgtggtacgtcaatgaaatttcacaatgagggcactggatgacatatccgcagtccctgcacatgacaaatgaggaatagcctcttttgtttaaaaacagaacggcctgctctcctttttcaagagtttcctcaagcccggccattaagtctttggaaaacatcgagcggtttccgctgcgcagttcctctctcatatcgacgagagacacgtcgggcatgacttggtgattgacgcggtgcttgagagaaagaagcttgtacacgccttttttcgccctcgcgaacgattcgagcgtcggcgtcgcactgccgagcacgaccggacaccggtggtattcggccctttgaaccgccgcttctttcgcatggtatctcggcatctcctcctgcttgtacgatgtttcgtgctcttcatcaattataatcatgccgagattttcaaacggcgcgaaaatcgccgagcgcgccccgacgacaagccggacttctttgcggtggattttccgccattcatcatatttttctcctgttgaaagcccgctgtgcagtacggctacctgcgagccaaagcgccctttaaagcggttgaccatctgcggcgtcagggaaatttccggaacgagaacgatcgcttctttgccggcttccagcaccttttcgatcgattgcagatagacttccgtttttccgcttccggtcactccgtgaagaagaaacacatcgtgccgcttttcttcgattgcatccgctatcgcctcgtaggcctgcgcctgctcttcagtcagcggaagcggttcggtttttttgaacattctgtcctgataaggatccctgtaaacctcctcttcgctttcctttaacagccccttgtcgatgagcgctttcaaggacgcggaagagccccccgttttgtcgatcagatcctttgccggaacagcgccgccctctttgcggtcgatgaaaaactgaaggatcgctttttgtttgacagcttgcggagagaggccggcaagcgcttcttttaaatgttctttcgcgcaaaggggggcgatcattctccgcatttttttgtttgttttctgctttactttatacgccacttcaagattgccttcttgaacctggcgctgaatcagctttaatgttccgtggtcatttatatcggaataagaaagcgtctctttttgcgagaacaaggtttttagcggttcgggaagcggtttatcgccgatcaccttgatttctttgccgtattttgctttcatagccgcggggagcatcgcctgcaaagccgtaattttaaaagaaagtgttttttctgtcagccagtctgacagctcaagcagctcctccgtcaaaacgggcgccagatcaaggatatcctcgatatccttaaccgaacggccggcaagctccgacgattctttcacgctggtgacaaatccctggattttgcgggcgccgaacggaacgatcacgcgcatcccttttttaatcatacctttgaatttgtcggggatgcggtaatcaaacggtctgtcgatatttttcgttgtaacatcgacgatcacttcagcgaagttcatgaagacgtcccgctccgtccggcaagctcagcggcttccttcaagactgcggcggcaacctcccgctttgacattagaggatgcgccgtctttttgccgtctcgatgaaacaccgtcacgatgttggtttccgttccaaaaccggcgccttcagccgtgatattgttagcgacaatcatatcgagatttttcgtctccagcttttgtttggcatagtcttcgacgtgctgcgtttcggctgcaaagccgaccaagatttgctttgttttccgctctcccagcgcttttaaaatatccttcgtccgttcaagctcaatgacgaggccgccgtcctttttcttcattttttgatcgtggacatgttttggcctgtaatcagcgacagctgctgttttaatgacgatgtcgctctcatcgaaaacagacagagccgcttgatacatatcttctgcggactgaacatgaatcacgtcgacccctgcgggatcatcaagcgatgtcgggcctgcaatcagcgtcacgtgcgctcccattcgtgccgcttcctcagcgaaagcatagcccattttccctgtcgaacggttggagaaaaagcggacgggatcgacttgttctcttgtcggccccgctgtaattacgacgcgctttccttcaagcaaaccgcttttttcgcttgaaaaatacgactctgccaactggacgatccgctcaggctcttccagtctgcctttgccgatatagccgcacgcaaggtagccttcactcggttcgataaaccggtagccgtctttgtaaagaacgctgatgttccgctgaacggccgggtggtcgtacatatgaacgttcatcgccggagcgatccacaccggcgctgtcgtcgccaaaagcgtcgtcgtcagcatgtcgtcagcgatgcctgaggcgagttttccgatcacattggccgtagccggagcaacgatcacgagatccgcccaatctgcggcatcgatatgggcgatgacacggggattcggttcttcgaacgtattggtatatacttcattgcgcgaaagcgcctgaaaggtgagcggagacacaaattcacaggcggattttgtcatgatgactttcacattggctcctgcctgcacgagcttgctcgttaaggcggccgctttgtataccgcgattcctccgcttactcccagcaggatgttgcgatttttcagcatcgtatttctcccccttatgttctgttcgccagccctgaaaaaaataacaacctagtgtataggttgctatttttaaggctattagcgattttccttttcgaatgtaagcagtccggcatcaatttcttccaatgctttgcctacaaatttatgcgacttcggattttcgatctgcgcgtctttgttcatctgcatttcgcgggcgcgccgtgcggatacggtaacgagcgtgtattttgaatccagtttgttcattaaagagtcaattgacggatctagcatatttattcaacctccagcattttcttatatcttggagcaactcggtcgcgccgtaaatgttcggcgagaacgattgctttgattctttcgcacgcaagctcaatgctgtcattttcgacaacatagtcataggcgtccatcagttcgatttcttccttcgccgctttcatccggttttcgatcagggcttctgtttctgtccctcttgtgacaatccggtttttcaattcggcgaggctcggaggcgccaaaaagataaacaagccttcaggaaatgcctttctgacttgcagcgcaccctggacttcgatttcaagaaaaacgtcccttccgctttcaagcgtctgttcgacgtagtcaacgggtgttccgtaatagttgccgacatattcggcccattcgagcagcttgttgttctcgatcatctcttcgaactcttcgcgcgtcttaaaaaagtagtcgacgccgtctctttcgccttgacgcggttttcttgtcgtcaccgaaatcgaatattcaaattttgtgtcctcctgagcaaacagcgcctgcctgactgttccttttccgacgccggaagggccggagagaacgattaacaaacctctttctttcataaagctcttatccctgcccttcatccataatttcttctttaacggaaagcctttgtgctactgtctcaggctggacggcagataagatgatatggtcactgtccataatgacaaccgcacgggttcttcttccatatgtagcatctataagcatgccgcggtctctggcatcctggatcatccgcttaataggcgcggactcaggactcacaatcgagatcagccgattcgcggatatgatatttccaaagccgatattgatcagtttaatcgtcatcctatacgttccccctgtacttggacgtctctagtttaacctgcagagaacatccgtaaacaatacgcacaatcgctattctatattttgcacttgttcttttattttttcaatagagcttttcatttcgaccacatgttttgtgatctggtgatcattcgcttttgaaccgatcgtgttcgcttcacggttgagctcctggacgaggaaatcgagctttctccccgcggctcctcccgctttgcaaatatcgcggaactggcggaaatggcttttcagcctcgtcacttcttccgtgatatccgaacggtctgcaaacagtgcgacttccgtcagcaggcggctttcatcgagaccgtctgttgaccattcttcaagccgcgcctcaaggcgttcccgatagtggtcgacgaccttgggagcaagctctgcgatgtcgtctgtcagcttttcaagcctttcaatatgctgaaggcagtcgtccttcagcctcagcccttccgcttcgcgcatgctgcacaattctagaacggcagcctcgaccgcttccagaagaacctcttcaagcttgtcattttggattggctcttcttcaacttggatgacatgctcaaactgaaaggcgtcttgaagcgtgatgtctccagaaagcccgcagcggtctttcatttcgcgcgcggctttctggtactcttcaagcagcggccagtcaacctggattttccgggtgaccagagcctcgtcgtcaacggaaacaaacagctccagccgccccctttgtatatgtttaaaaatcgtttgctttattttgtcttctaaatagagcaaaggtcttggcatgcgggcgtttacttctttaaaccgatagttgacagatttcagctcaacggctgctgtcagcccatccttcgttttgctcgcgctgccgaaaccggtcatactccgtatcataaaacacacccaattccgtataagtgaaaaagactttctttgatttaaatttacgcaagatgaaaaggcaatagaaacctctattacctttaagattatatcatacaagcctatttttttcttgtcaaaagtgacccggccagtaaaaaagttggaatcgccgacattccgacaatcaggagccagtctgccattaaaatcggaaccgtatgaaaaatcggctgcagcggcggataataaataacgacaagcatcaaaagaatcgaagacagcactgcaccgagcaaataaatgttttcaaacggattgcggtcaaagatggaccgctcgcttcggcagtcgaacacgtggatcagctgcgcaaggacgagcgttgcaaatgcaaccgtctgtgcatactcaagcgcttctggattgcggttataaatgaacataaacgccccgagtgtcgcgattccgattaagaatccgcgcgatacgaccttccagccgagcccccttgcaaacacgccttctttcggactccgcggctttctctgcatcacatcgtcctcaggctgatccatgccgagcgccatggcaggcaggccgtccgttacaaggttgacccacagaatctgtatcgggacaagcggcagcggcagagcgagcagcattgcaaacagcatgaccaaaatttcgccgacattggatgcgagcaagtatctgatgaactttctaatattttcatagatattgcgtccttccttgatggccgatttaatcgttgcaaaattatcatcgacaaggatgagtgaggacgcctccttggcgacatccgttcccgtaatccccatcgatatgccgatatccgcctgtttaatcgcaggggcatcattgactccgtctcccgtcatggcgacgatgtggccgttttcctggtaggcggtcacgatcttcagcttatgttcgggcgacacccttgcaaatacgtaaacatcgtcaacaatttccgccaattcttcctgcgagagttcgttcagcatctggccgtccatgacctttccgcgcggaggcagcaatccgagatcttttgcaatcgccgtcgccgttatcacatggtccccggtgatcatgaccgttttgatccccgcttcccggcattctttaatcgctgttttcacttcgggccgcggcggatcgatcatccctaacagcccgatgaaagttaagcctgactccgctttttcgagcgggggattttctgtatctttgatcggtttatacgcgacggcaatcgttctcagcgcctgtgacgcaagagtttccagcgccgcgcttgtttcagcgagcctttcctttgtgaagatttctcgcttttcttctgtcagcgtatgcgacgaacgcttcatcaatacatccggcgcgccctttgtaatgacaaagcgcttgccgctcttgtcttccacaatgacagacatcattttccgcgttgaatcaaacggaaactcctcgatgattttaaaatgttcatcaacatatttgtccgtaaagcctgcttttcgagccgccgtcagcaaagccccttcggtgggatcgccatcaagacgaaactccccgtctttttcgataatcgaagatgaattgcataatgcgccgaacaatagtacctgctggagcggtttatgatgctttgcttgcacatcgcgcccgttcatgctgaaagagccttcaggctcatagccgatccctgacacgttccatatcttcccgcctgaccagacatgggtgaccgtcattttgttctgcgtcatcgtcccggttttatcggagcaaataatggacgcgcagccgagcgtctcaaccgcgggcagcttcctgacgatcgacttttgcctgatcatccgctgcacgccgagagacagagcgaccgtgacaatggcaggcagcccttcaggtatggcagcgacggcaagggaaactcccgctaaaaacatgctgtataaatcatgcccctgaatgacgccggcagcaacgacaagcagtgtcaggaacaaagcggcgacaatcaaaattttgccgagctcttcaagccttctttgcagcggggtcgccgtattcccggcagattcaagcatatcggcgattttccccatcgcagagttcatacccgtaccgatgacgacgccgattccgctcccccttgtgacaagcgttcccatgaaagccatattcttcagatcgcccagcgatacatctgacgcctgaaaagcatctgcctgtttggacacggggagcgattcacctgtaagggccgattcttctatttcaaggctctttgtctcgacaagtctgagatcggcgccgattctgtctccgcttgcaaaacggacaacatctcccgggacaagctctttggaaggaattttcacccaattcccctcccggagcacagccacttgaggagctgacagttctttcaaagcctcgagcgacctttccgcccgcctctcctgaaagaatccgagaatgccgttaacaaagatgatcgcgatgatcgcgatggcgtcaatgtattcgccgaggaaacccgaaatcaacgtggccgcaagcaaaacaagaaccatgaaatctttgaattgagaaaaaaacaatgcgaccgccgatgttttttccccttcctgaagttcgtttgttccgtgtctttccagccgctttccggcctctttttctgttagacctttgtcgatggacgtttttgttatatttaacaattcggtttgtcccatctcgtgccatttcattgaatcgtccactcctcctgccctaaaggttgcttttggtgtatccatctctataagtcaatttattcagactcgtcccaaatcatgctataattattgaatggacgttttacgaagaggattaacgagaaaagggagtttttcatatgtcttttgacggcatttttacatacggaatgatcgaggaattaaatgaggcgattcgaggcggacggatcgcaaaaatccaccagccgtttaagcacgagctagtgtttcatatcagggcaaacgggaagaaccgcaaattgctgctctccgcccatccgagttatgcgcgggtacacctgacaaacgaaacctacgacaacccgagcacccctccgatgttctgcatgctcctccgcaaacatctggaaggcggctttatcgaccaagtcgagcaaatcggcatggacagaatgatggtctttcatatcaggagccggaacgaaatcggcgacacgctgacaagaaagctgatggtcgaaatcatgggcaggcacagcaacatcgtgttaacagacggagaaaaagacgtcatcatcgacagtttgaagcatctgtcacctgcgatgaacagctaccgcaccgtgctcccgggatacgattacattctccctcccgcgcagaacaaattgtctccgcttgaagcggagactgaagatattctccgccatctgaatttccaggaaggcaaacttgacaggcagatcgtcgataccttctccggcgtctcgcctctgtttgcgaaggaagccgtctttcgcgcgggtctagccaacagggcgacactgccaaacgtcttgacggagatgttcagcgaaatcaaaagccggcgttttcagccccagcttgtcaccacagaagacggaaaagaatatttttaccttcttgagctgacccatataaaaggagacaacaggccctttcatacgctgagcgaacttcttgaccgctactatttcggaaaagcggagcgtgaccgcgtcaaacagcaggctcacgatttagagcgtttcgcggcaaacgaaaagaaaaagaacgaaaataaaatcaaaaagctgaaaaaaacgcttgagcagtccgaacacgcgcaagactatcagctgtacggagagctgttgacagcgaacctgtaccagctgaaaaaaggggacaaagaggcgaaggtcatcaactactatgatgaaaacggcggagaaatcacgattccgctcaatccgaataaaacgccttctgaaaatgcacaaagctattttacaaaatatcaaaaagcgaaaaattcggtagaagtcgtgaaggagcagatcaaattggcagaagaggaaatcgcttatttcgaccagctgattcagcagctttcatctgcctcaccgaaagatataaccgaaattcgcgaagagctcgccgaaggaaaatacttgcgggccaagcagcaagggggccagaagaaacagaaaaaacaggcgccgacgctcgaagcatatgagtccagctcaggagaaacgattctcgtcggcaaaaacaacaagcagaacgaatatttaacgatgaagcttgccgcccgcgaccacatctggcttcacacaaaagatattccggggtcgcacgtcgtcattcaatcgaccgatccggacgagcaaaccattctggaagcggcgcagatcgctgcatattacagcaaagcgaaaaactccgcttcggttcccgtcgactatacaaaaatacgccacgtcaaaaaaccgaatggcgcaaaaccggggtttgtcacctacgacagccagcaaaccgtttttgtaacacctgatgaagacttgatcatcaagctgaaaaaataataatgccaaaagcctgaacctcaagggttcaggcctcttctttttcggaaaagctcgtcgatctcttggacgagctcatcatcgatcaaatcatcgatctgtccggccagcctgatcgtgtggcgcgggctggctccgtttgttgagacggatatggttatgtttcctctgttgattatttttggaacatatacatttcccagctccgcttcactcgcaacattgacgagctgctcaggagctgccgatgcggcgagacgcttgtttgcctcatggtcatcggtcgcaagaatgatcagaaatgcattcttgaaatcaccgggttccgcctttttcttcttccattcgatgccgtgttcgttaatcaatccgagcatctcttctgatgcttcagggctgatgacggtcgcggatgcaccttctgccagcaccgttttcagccgccgcgccgcaatcttccccccgcccgcaatgactgcggctttgcctttcatgttaatgtgcagcggcagcatctgatgctcctgtaaaatcaaagcggccggctttgttgataaccgcttcctctacgcggtgcaaaaaggcgttttttacatgggggtggaagccgaggtaatccgtcagcacgacattcggattcgtttctttcagctttgcggtttccctttcaatctcgttcatcagcataccggtgaacagcagatacggaacgatgaatgtcgtttttccgtcccgttctttaagctgtttaaacacatccaggtagtgcggctcacaggctgtcataaagcagggaatgacctcatccactggtgtgaggtctctcagccgttcgcaaatatcataaacatcccgtttgacatccggatcagagcttccccttccgatcaacacgactcttgcatgttcatatggcgtccccgtttcttcgatccttgtaaaaaccgctttgacgacttcctgatcgacgccgatcggctttccgtaagcgacgctgacggaagggtactgtgaggaagcacgggcaagctcttcagggatgtcccttttggcatgtgcggctgtcaagaggagaagcggcacggccgcgatatgcgtcgcccccttttccacacacgctttaaagccggtttcgatatccggtgccgccaattccaaaaaagatatttcctgaatgggggcggacatgttttctttgcagctctccaaaaaagcggctgcttctgtttgggctcttttcagacggcttccatggccgatatataaaatcgcttgtttcatattaaagcgcctcgcttaatgccggatctttcagctcaggttcaaaccagcttaactgcgagctgaattgaacgacatccccgatgacaatcaggctcgggttttcaatcttttcgctttcgactgtaccggcaagcgtttcaaccgtgcaaagcaccgttttttgtttgtctgtcgttccccaatggatgaaagcggctggcgttgacgggtctctgccgttttcgatcagaagcctttcaatttgcttcacgtttttaatccccatataaatgacaagcgtatcgatccctgtggctaacgctttccacttctcttcaaagttttcttctttttgataatggcctgtcacgaaagcgacgtttgaactcgcttcccggtgtgtcaccggaatgcccgcataagcagcggcagctattcccgaggtgattcccggcacgatttcaaaagcaaccccgtgctcagcgagggtttgcgcttcctcgccgcctctgccgaatacgaaaggatcgccgcctttcagtctgacaacggttttcccttttttcgcatacttgacgagaaaatgattgatcgtttcctgcttcatcatgtggtagtccggaagctttccgcagtagatgagatccgctccctccttggcgtgctgtaaaatctgtttattcacaagcctgtcatacaaaatgacatcggctgtctggatggcttttaaagctttgatcgtcagtaaatcggggtctccaggacctgccccaacgatatatactttccccatcttagatctccccccgatctgatcaacgtcttcttcaattcattataaatcataaagaaagcgtttggtgcctgaaaatatcacaaaaaccaaacgttttctttatgaaataggaaagtgcatgcgctgcactttcctattcacccgcattttatttcgtttgatctttcacgtattggacgagctggtttttgcactcttcccggttatgtgcgcctgtatcaagaacaagctcaggcgtttcaggctcttcataaggcgaatcgatccctgtgaaaaatggaatttctccgtttctcgcttttttgtacaagcctttcgggtcgcgctcttcacacgtcgccaaatcgcatttcacatagacttcgtgaaactcatcttcctcgacaagctgtctgacaagcccgcgatcttctttaaaaggagaaatgaacgccgtaatgacgatcgtcccctgttcgacaaagagcttcgcaacctcgccgatccggcggatgttttccttccggtcttcatcggaaaacccgaggtccttgttcagcccgtgcctgacgttgtcgccgtcaagcaccgtgacctggtagccttgtgcaaacaactcacgcgcagcggcgttggcaatcgttgattttcctgaaccgcttaagcccgtcagccaaatgattgagcttttatgttgatttttctcatgatattcccgttttgtaatggacgcttcatgccagacaatatctttatttaccaagagatgctcccccttaagaaaccccggccgctaagcctttgattaatgtttgaataacttcgggacggctgaatgtgctcggcgggaactcgccgcttctcagcatcgccctcacctttgtgccggataaaatgacttgatgttctttgccgtgagggcacgttttcgccgtagccattgaaccgcagacattgcagtagaagctgtgttcgaatttcagcggcgtaatgccgatttcttccggcgcgaactgatcgaacagctcctgcgcttcatatgtgccgtagtaatcgccgactccggcatggtctcttccgacgataaagtgcgtgcatccgtagttctttctcacaagggcatggaagatcgcttccttcggccccgcatagcgcatcgccgccggaaaaacgccgaggaagacgcggtctttcggatagtagccgtcaagcagcacctgatagctttccatgcggacatcagccggaatatcgtctgattttgtttccccgacgagcggattgaggaaaaggccgtctaccgtctcgagcgccgttttttgaatgtattcgtgcgctctgtgaaccggatttctcgtctggaatccgacgatcgttttccagccgagttccgcgaatttttttcttgtttcaagaggttcgaatgtgtgcgccgggaattgttttacactccgcttaatgagcgtgatcggcccgcccacataaacgctgccgcggtcaaacaattttttgacgcccggatgttcgagttcgtcggttttatagatattgacggcttccgttttcttgtccggcgtatagatatcttcgatctcaatgacgccgtaggtttccccattataggtaaggcggacggtgtcacccgcttttaagcttaaagctttttgctcgtcaacaggcagagtgatcggaagcgtccatacttcgccgcttgatagtctcatattttcgaaaacggacagatagtctttctctgtcataaagccttggagcgggctgtacgcaccgattccgatcagctccaaatctgaaaaagccattacatcaagctcaatttcatgtgcgatatgttgaaaatcgtatgcttcattgacgcggttaaccaatacaccgccgtgtggtgctaaactcataaacttgtttccccctactttgtgtttaaattcctccgccttgttcatggacggagctgtgctcttttttgaccgctctcatcaggctgatcgttccgacagatgccagcagaacgcttgtgacaacaataagagcgtagtagtctccttttaataaaaggctgaccagcatataagataggcttaatgaaaggaacggcgagacgacccatactttcagcatcgttttgaccacttgtttatgaaagacgttgccgccgttttttgccattcccatccctataatagaagatgatgtgacttgcgcaagcggaaccggtaaaccgaaaattgaactggtaatgacaagcccggcccccgttccggaaaggatgattccctctccttttgaaaacctcgtaatctttttgccgtttgtttcaagaacgcgcctgcccagtaaaagggcgcccagcgcgacaaacagcccgccgtagagcgttccttccccgactgtcaaaacatgcgccgccaccagaggtccgacagcgtttgcgacattgttcatgcccgctgagaaggcttcaaaaaaccctgtgatcaatagaatgaccgccaaaacctttgctttttttcccgaggctggacgtttgatcgtttttttcatgatttttgccatcgcaaatgtaaatgcaaaagcgacgattggtacaatgacccaaaatgagacgatgacaagcaaagatttgacatacaaaacctggtatgcgacacctactccgacaacagatccgactgtcacttcacttgtcgaaagcggaatgccgagtacatttgcgataaagagcgacagcgccgctgatccgataataatgcagacgatttcaagcgaaatcacccgttcgggaatgatgcctgaactgatcgttttcacgacgtttcctccgccgatgacagcgcccgagagaacgcccgctgcacagatcaggagggcgtgaaacttctttttgacagcttcagatccataggcgatccccattgaagcagctgcaccgctcgctccgatattcatcgcaaaaaacatgctaaataaaatggcggcaagttccatgactcatctccttactcgtgtaatccgcattctgttttagccgatccgttccagcggccggatcgaagatcatccattgtaaaggccggagaggtgcacggagcgcagccgatgctcggatagccttgatcatgaagcggattgtatgggagatcgtgctttgtcacatatctccaaatatccttccacgtccaatgaatgagcggacaaactttgatagacttgaatttttcatctttgttcaaaaaattcgttttgctccgtccgggcgattgctcgcggcgcagaccagacagccacgccgggtagcctgaaagcgtctcgcggagagggatgaccttcctcatttcgcagcaggaattcggagcggtcttccatagttcgtccccatattctttcgcctgctcttcgacggtaagctccggttttttcatgataatctgaaggcctggatatcgttctttgacggcgtcgatcgtttcatacgtttctttaaaatgaagccctgtatcaagaaaaacgataactgcatcttttttcaccttataaatcaaatcgatcaggacgatcccctcaattccgaagctgcacgcgtatacgagctgatccccgtaatgtccgtacgcccatttcaggacggacagcgctcctttataagagtcatcttcctgaaaagagatgtttggttcctcccatgtgctgtaagtaaaaattttcggttcccccttttttcgccaacaaaaaaacggcttccagcagaaaaaaaaactgtgaaaaccgcctctagtttgtctagtcagctatttcaatcttattttttcatttttttcgatttgaatgactttgccgtcctgaacaacgaatgtgatcgatccgtaattcatgtctttcagcatgtctttcattttgatgatcaccttttcaagctgttcatctgtcttcacttctagctcctcctctgcccctaaaaaattaaaatctttcttccaattttgaaagaaagacgaggaactccgctattccttatctctcaaaatgagggcattttgctggaagtagcaccttacgcttcacacgcaggttgccgggtttcatcggaccagtccctccaccgctcttgataagtttgcttttgttattttaaaattttagcacaattcgaataaaagtcaacccgactttttttataggattaataaaaaataaaaataatccgattttactattttaaaaacggcaaaaaggcgcaaaaaagccgttctcccatttggagaatacggctttgatcatcagttcatccaagacttgctttcaggatccgctttccattctttcagtttggcggcatcctgttcagtaatatatccaccggcaagcgcagcctcggtcagcgtatcgtaatcagtcagcgtgtggtattcaacgcctgcttcgctgaaggcggcggcggcttttggaagcccgtaagtgaaaatggcggcgacgccgagcacttcacatcccgcctctgtgagggcggcggcggcttcaagaacgcttcctcccgttgaaattaaatcttcgatcacaacgactttctgtccttttacaacggccccttcaatttggtttcctttgccgtgcgccttcggtttgcttctgacgtagcacatcggcaggctcagcctgtcagcggcaagcgcggcatgagggattcccgcggtcgctgtaccggcgatcatctcggctccgggaaatttgtcttgaatcagtccggcaagccctgaagcgatatcatctcttacttccggatatgaaagcgtcaaacggttgtcgcagtagatgggcgacagaatgccgctcgcccatgtaaacggttcgttcgggcgcaggaaaaccgctttgatttttaataaatggtttgcaatgtctgttttcatgccttggttccctcccactcatgtcctattcttctgtaggctgacacaggatcttccgcctgggtaatcgaacggccgacaacgatcgccgacacgcctttttcccttgcgtagccaggcgtcgccacccggacctggtcgttgtttttgtcatctgccatgcgaattccgggtgtcacggtcagaaaatctacagacacagcccggtaaatgtgttcggcttcatgaacggagcagacgacgccgtcaagaccgctttcttcagccagccggctgtagtggacaactgtatcgagaagcggcgtttcaatcaggagctcacgctgaagcatttctgaggacgtgcttgtcagctgagtcacggcaattaatgaagggcgtttttggcctgccggagtccccgcttcaaggccttcaagcgccgactccatcatttgctttccgcctgctgcgtgcacattgacaagactgacgccaaatcccgccagccttttcaccgccttgtatacggtcgttggaatgtcgtggcactttagatcgaggaaaatgcggcagccgcgctcctgcagattttcaaggatggcaggtccttcctgataaaaaagctccatgcccaccttaacgaacagctcttctccttgaaaccggtccaaaaacgcatatgtttcctgtgctgatgcaaaatcaagcgcgatgatgggcggcgtattgttcatccttccagctccttccgatacactcgttcaacgaacggtatccgtatttttctaaaacgcgcggcaaatcgtcgatgatgtcgggacaagcaaacggattaacgaagtttgccgtgccgacggcgactgcgctcgcacccgccagcaaaaactcaagcacatcttcggctgactggacgccgcccatgccgatgatcggaatgctgaccttttggctgacttcatgcaccattctgatggccaccggtttaacggcaggtcctgataatccgccggttttgttcgccaaaatcggctttcccgtttttaagtcgagccgcatcccgatcagcgtgttgatcatcgtcaaaccgtccgctcccgcttcttctatggcaagagcgatgtcggtaatgttcgcgacgttcggcgacagcttcacatagacggggacgctcgcaacctctttcaccgctttcgtcagctcgccggccatttccggctgcgtgccgaaggcgatgcctccggttttcacattgggacaggaaatattcagctcgagcgcatgaacgtttggcgctttgctgatttcttcagccacctcaacataatcctcgatctgcgagccggcgacattggcgataatcggtgtatcgaactgttcgagccacggcaattcgcgttccatgacagcctttaaacccggattttgcaggccgatggcattaagcatgccggcttgcgtctcggcgacgcgcggcgtcggattcccgaagcgcggctcgctcgtcgtcgctttaatcatgatcgcaccgagacgcgaaagatcgtaaaagttcgcaaattctctcccgaatccgaagcagcctgaggccggcatgatcggatttttcaattgaaggcccggcaaattgatttcaagcatcataacagcacctcctgggctttgaaaacaggaccgtcaaggcataccttcacataagacgtttcgctttcttccgtatggcagacacaggcaaagcaagcgccgatcccgcatcccatgcgctcctccattgacagatatacctctttatccggatagcgctgttttaaagctttcagcatcggcgtcggtccgcaggccattatgcagtcaaactgaagcccctcgttttcaatgacatctgtaacaaatccctttgaaccgcgggtgccgtctgcggttgccacatacacccggccgaaacggctgaattcctgttcgtaaaagacatcttttgcagaagcaaatcctaacacatggatcgcgtgcacccctctgtttgtcagctgtttgctcagctcgtaaagcggcggaacaccgatccctcctccgacgagaagagccgttttcccctgttcaagcgattcagccggaaaaccgttgccgagcggaccgagaacatcgagctgatctccttcctgttttaaagaaaggagtctcgtgccttccccatctttgcgaaagatgatggtcacctgccgggcggctttgttgatatcagcgatgctgatcggccgcctcaaaagcggcgtgagggagtctgagaccttgatgtgaaggaactggccgggagcgccgcaaacttcggcaatctccccttccagcaccatttgataaatatgatccgcgatgcacttgtttgaacggactgtcatatacccttttctcatctgacggccgccttttgggcgattttaatcgccggcatatgatcggcgcggaagctcatgctttcaagcacccgcaaaatcgcttccgccgtatcaagggatgtcaggcaggcaacgccgttttcaacggattcgcgtctgattctgaagccgtcccttgccggctgcttcccttttgtcagcgtattgacgacgaactgcgcctccccgtttcgaatgacatcaaggagatttgtaccttcttcgccgattttcccgacggttttaacaggtacggatgcatctcttaaatagcctgccgttccttccgtagccaagattttatagccgatcgcatggaaccgcttggcgatcaacagcccttcctctttatctttatcagcaactgtcaggagaacagagccgtagttcggaatttgaatgcctgaagcgatcagtcctttatatagcgctttttccaatgtgctgtctttgcccatgacttccccggtcgatttcatttccggtccgagcgtgatatccactcttctaagcttcgcaaacgagaagaccggcactttcacatatacgccttcctgctctttttggaggccttctgtatagcccatatcggcaagcttcccgccgagaatcacctttgttgcgagattggccatcggaatgccggtgattttgctgagaaacggcaccgttcggctcgatctcgggttgacttcaaggacgtaaacctcatcttttgaaaggacaaactgaatgttgagcaggccgacgatgtttaagccctttgctagcttaatcgtgtatgcttcaagctttttcttgatgtcctctgaaagggattgcggcgggtaaacggcaatcgaatcccccgagtggacgcccgcccgttcgatgtgctccataatccccggaatgacgaccgtttcaccgtcagaaatggcatccacttctatttcttttccggtcaaatatttatcgatcaggacagggtgctgcggattgatttttactgcattttccatataatggagaagctctgcttcatggtagacgatctccatcgcacgtccgccgagtacatacgatgggcggacaagcactggatagccgatattggctgcgatttcaacggcgccttccacagatgtcgccgtttttccaagcggctggggtacctgcagcatttcaagcgtctgttcgaacttgtcgcggtcctcggcgcggtccaaatcttcaagggatgttccgagaatggcgacgcccctttctgcgagctcgtcggcaaggttgatcgcagtctgtccgccaaactgaacgacgacgcctttcggctgctccaaatcgatgatatgcatgacatcttcaacagtaagcggctcaaagtagagcttgtcggatatgctgaagtctgttgaaaccgtctcaggattgttgttgataataatggcttcatagccggcttctttaatcgcccagaccgaatgcacggtcgcatagtcgaattcgaccccctggccgatccggatcggaccggagccaagaacgatgacgctgtttttgtccgttctgaccgattcgttttcttcttcatacgtgctgtagaaatacggcgtctccgattcaaattcggccgcgcatgtatcaaccattttataaacaggcgtgatgcctgcttcttttctaagatcataaagctttcgttcaggcatctcccagagaaggctgataaagcggtctgaaaagccgagctctttcgcttcttttaaaaggccgaggtcgccgcgtccggctttcagcttctcttcaaagcggatgattccctcaagcttgtggaggaagaacaggtcaattgccgaaaattcgtggaggtcgctgactgtgtatcctcttctgaacgcttcggccaggtaaaagagccgttcgtctcccgcttttttaatccgtttttcaagcacttcattcgagatctcaccggcatctttcagttccagatggtagacatccgcttcaagagaacggaccgctttcaggagagattcctcccacgttcttccgatcgccatcacttcgcctgtcgctttcatctgcgtgccgagcctgcggtttgctgattcaaatttgtcaaacggccagcgcggtatttttgacacaacatagtcgagtgcaggttcgaaagacgcgtacgtttttcctgtaacaggattcatcatttcgtcaagagacaaaccgacagcgatttttgcggcaagctttgcgattggatagcccgtcgcttttgaggcaagcgcagaagaacggctgacccgcgggttaacctcgatgatgtagtactgaaagctgtccgggtcaagcgccagctgaacattacagccgccttcgatttcaagcgcgcggatgattttcagcgagacattgcgaagcatttggtattcgcggtcgctcagcgtttggctcggtgctacaacgatgctgtccccggtatgaatcccgaccggatcgatgttttccatattgcagacgacgatcgcatggtcgctcgagtctctcatgacttcatactcgatttctttgtagccggcgatgctcttttcaagcaggcattgatgaaccgggctcatttttaagccgttttcaacgatttccttcagctcgtcttcgtttgagcagatgcctccgcctgttccgccaagcgtgtatgccggcctgacgatgacggggaaaccgatgcgctcgacaaactcgcgcgcttcgccgagcgagtggatgatctcgctttccggaacaggctcattcaactcattcatcaagcttctgaacaaatcgcggtcctccgctttttggatcgccgacaatttcgtgccgagcacttcgacgccgcactcagccaagatgccgtgctctgacagttcgaccgccaagttgaggcccgtctgcccgcccaatgtcggcaatatggcgtccggccgctctttgcggatgatccgtgttaagaattcaagcgtcagcggttcgatatacacgcggtcggccatttccgtatccgtcatgatcgtcgccggattcgagttgacgagaataacttcatagccttcttcttttaaagcgaggcaggcctgtgtgcctgcataatcaaattccgccgcctgcccgataataatcggccccgatccgatcaccaaaatctttttgatatctacacgtttaggcataccgcttccccttctttctctgtggtttcaatcatgtctaaaaattgatcaaataaatggtttgcgtcttccggccccggtgaagcttccggatggtattgaaccgtaaaagccggttcgtgtttatgtttaagcccttcgattgtgtcgtcgtttatcgccacatgggtcacttcaagcggcgtgttttcaacagacgatacggtatagccgtggttttgagccgtaattgatactctgccggtttcaagctctctaaccggatggttggaaccgcggtgtccgaacttcattttctccgtctttgctccgcaggcgagggcaaacagctgatggccgagacagatgccgaacagcggaaccttgccgagaatgttttggatcatcgcaatcgcttccggtacgtccgttggatctccgggtccgtttgacagcattacgccgtcaggcttcagctgcatcacttcttctgccgttatattgtggggaacgacgatcacatcgcatttgcgcttgttcagctcccttaagatgccgtgtttcattccgaaatcgacgagcacgattcgcttccctctcccagggctcggatatgccgtttttgttgatacttggctgacctgatcggtcggaaggttcgtttctttcagcttttgaaccaaagccccagcatcttcttcagggccggcaaatacccctttcagcgtacctgccgttctgatcattcttgtcagctttctcgtgtctatccctgagagtcccgggatgtttttcatttttaaatattcatcaagtgtataagcagagcgccagtttgatggaagttgacataattcctttacgataaacccttttacataaggggtgatggattcaaagtcgtctctgttgatcccgtagttcccgatcaaagggtaggtcagggtgacaatttgtccgcagtatgacgggtctgagaggatttcctgatagcctgtcatccccgtgttgaagacgacttctcccatggtgttttccaggctgccgaatgcttccccttcaaaaatcgttccgttttctaatataagacgtcttttcattttacaagtctcccctcttggtaaacgagttttccctttgccattgtcatagccggccagccgaagcagctgatgccgtcaaacggcgtgtttttccctttagaaagaaaggtgcttttatcaattttttcttcgcgttcaagatcaatgagcgtaatatccgcggaccgtccggcttcaagcttcccgtacggcagcccgaacgcctcgcaaggtttgaccgtcatataatcgtgcagctgtttcagcgtccatttgcctgttttgacaaagtgcgtgtaaaggagcggaaaagccgtctccaagccgacaattccaaaaggcgcaaggctcattgtctgttgtttttcttcttctgtatgcggggcatgatccgttgcgataaaatcaattgttccgtctctaagcccctcaaggagcgcttccctgtcttccggacttctaagcggcggattcattttataattcgtatcaaggccgggaatgtcgctgtctgaaaggagcagatggtgcggcgtcacttccgccgtcacgcggattcccgcttttttggcgtcgcggacgaccctgaccgattccttcgtgctgatatgacagacgtggtaatggcagcctgccgcttcggcaagaagcacatcccttgcgatgtgaaccgcttcgcacaccgaaggaatcccgtttaaaccgttggctttggcaaattccccatcgtgtacactgccgccgtagatcagtgaattgtcttcacagtgagcgacgatcgctttattaatcgaagccgcttttttcatcgcttcatacatcatccccgccgtttgaacgccgacgccgtcatcggtaaacgcgaacgcgccggcgtctttcagcccttcgaaatcggtcatttcccgacctgtttgcctgatggtgattgaagcatacggcagcactctcactgatgccgtttcgtcaatgcggttgacaagccactccatctgctctttcgtatcggggacaggccgggtattcggcattgcggcgacagttgtaaacccgcctctcgctgcggcttttgcacctgtttcgatcgtttctttcttctcgccgcccggctctctgaagtgaacgtgaaggtcaacaagccctggcgagacgaaaagtccatccgcatcgatgaccgtttcccccgaagcggcctcaaggcttccgatctcgctgattgcatcgccttcaaccctgatatcgcgctgtactttttcgcctttttcgtcgagcatgaagccgtttttaattaaataagacataagcctgatctcccctttttttgttttcgccgtttagaagcgctctttttaaaaccgccattctgatatatactccgttttccatttgtttgaaaatcctcgaccggccggattcgaccagtgcactgtcaatctcgacgcctcggttgacaggtgcggggtgcatgatgaccgcgtcttttttcaagagctccgcccgcttgagcgacaatccgaatgtttcgagataatcgcgttctgccgcctttttctcatgccgttcgtgctgaatccggagaagcatcacgacatccgaatgtgcaaccgcttcgtcaggcgacacatatgtcccgtatggattgtcttcatcccgccattcgtctggacctgagaaaagaacctttgctccgagtcttgtcagcacttcggcattggaccttgccactctgctgtgcttgatatctccgtgtatggataccgtcagtccggcaaatctgccccattcctcgtgaatcgtcatcaaatcgagcaaagactgagtgggatgctgaccgcagccgtctccggcattgatcaccggaatgccgacatgtccgatgagttcatcgtaataatgatcatgagagtgtctgatcacacatacatcagcgccgatggattcgagggtcttgacggtatcgtacaacgattctcctttttgtacgctcgttgaaacaccgtccaggttcaacacattcatgccgagtttcttttcagccacttcgaagctgaagcgcgttcttgtgctcggttcaaaaaacaggttggcagcgaactttccggagagaacggaatcggacttgccttttttcagctctctcgcctcttcaatcagctcgtgaatatcctcaagactaagctcattcattgcggtcaagtgtttcattttttctccccctcaggcttaatttcccgtaaaaaaaccccaggccataacggcttggggtacagtgaatcagagaatgcgcttttttgcacttctctctccgcaaccctttcaagcctctctggacttcatttaaaaggtttttaaatatgctcttctatttcaattccgtcctgatctccctttgattcaggcaggacaaggtttaaaaccactccgacgatcgccgcaagcgccatgcttgacagctcaaaccctgagatcttgataaatgcgccgcccactccgatgacgagaatgacggatgagatgatcaggtttcgcttgttttccaagtcaattttattatcgatcagcatgcgcagtccgctggatgcgatgataccgaacagcaggaaggaaacgcctcccatgactgcggaagggacagagctgatcagggccgaaattttgccgataaatccgaagcacagtgcaatgacagccgctccgccgatgacaaatacgctgaatactcttgtgatggcgagtacgccgatgttttctccgtaagtcgttgtcgggggtccgccgatgcatgatgcaagcatcgttgcgacgctgtcgccgaaaatcgagcggtgaagcccgggcttcttaataaaatcctggccgacgaccttgcttaataccatttggtgtccgatatgttctgacattgtcacgaaagcgacgggcaccatggcgattccgattccgacagccgccgcgctcggcgtatagtcgacaaacggaagcacgaagtccggaacagcaaaccatttggcgtcaagaaccatctggaagtcgacgattccctgggtcagggcgaacaagtatccgccgataattccgatcaagacaggaatcaggctgaaaaatcctctcaagaaaatcgcgcagattatggtgagcgcgagtgtgaatcctgcgacgccaaaatgcttggcgctgtagacgagcacttttgctcccgaatcttcatacatggccatattgacagccgtgcttgccagcccgagtccgatgacgataatgaccggaccgacgacaacaggcggcagaagcctcatcagccagtccgttccaagctgctggatgagaagggcgatcagcccgtaggcgatgcctgccataaatgcgccgatcatggccgcgccagggcctccggcggcttttgccgcgataatcggggcaataaatgcaaaggatgaacctaagtaagccgggatctgtccttttgtaatcaagagatacgcaagcgttccaagcccgcttgtaatgagggccacgcccgggcttaagcctacaagcttcggcacaaggatcgtcgctccgaacatggcaaacagatgctgcaggctgaaagatatccaattcaaaggttttggtacttctctgacaccaaggttcacttttttctgactcatattttttcctcctgatgatcgactcactgtctatgatgtcttcatatcctgaaatgatttatgcccattaaaaaagcctctttgcttaaattgcgcaaagaggcagacaaagaccgccgcacggtaaggcggctttctttcgttccatccctctttgcaaactcactggaatgcatttaaaaaaggattataggattatcattcactttttataaatcgccgcaaggtcgcgtccgtcaacttcctccaattgaaccatgaccttttcggttttcgacgtcgggatgtttttcccgataaagtcggctctgatcggcagctctctgtggccgcggtcgacaagcaccgcaagctggatggatgaaggccgcccgacatcgacgagcgcatccatggccgctctgaccgtccgtcccgtgtaaagcacgtcatcgacgaggatcaccttttgatcggtgatgtccgccggaatgtccgctcctttgacaagcggctctttattggacgtttttttggagagatcatcccggtaaagggtgatgtccagctctcctacggtgactttgtttccttcgatttgctcaatccgttcggcaagccgtttggccagatagatgcctctcgttttgattccgacaaggatacagttgttcattcctttgtttcgttcaatcatttcgtgggcgattcttgtcagcgcccttctgatcgcctgttcgtcaagcacaacagccttttcctgctcttgcatggccaaacacctcgcatcttttaaaggataaaacaaaaaccccttctgcataaaggcagagaggggtctttaaacgaattcattgattcgcttgtccggtatccttctcagcctctctggactgtgttaaagaatctgatttaactgcatttattatttcaaaaaagaaaacgtctgtcaacgtttatttcgaattttgtcgaggaggtttttcatgtcgtcaggcagaggcgcctcaaattcaacatattctcccgtacgcggatggtcaaaccccaatacgcccgcatgcagcacctggccgttgaaatcgaccgtctttttcggtccgtatttcggatctcccgcgagaggaaagccgatatatttcatatgcacgcgaatttgatgggttctccccgtttcaagctggcattcaacgacagtaaaatcgtcgaaccgttcgattacttcaaaatgagtgacggcatgctttccgttttcccttgtaaccgtcatactctgcctgtcttttttatccctgccgatcggcgcgtcgatcgtcccgtggtcatgcgggatgacgccgtggacgagcgcggtgtattttctcgttactgttttgttgacaagctggttcacgagcgactcatgcgccatgtcgtttttggcaaccatcaacaggcctgaagtgtccttatcaatccggtggacgatccccggtctcatcacgccgttgatgcctgacaggtcgtcacaatgcgccatcaaaccattgactagcgtccctgtcaaatggccgggagccggatgaacgaccattccccgcggcttgttgacgaccagtacgtcctggtcctcataataaatatcaagatccatcggttcagccgtgacatccagcggttccggttcgggaacctggactgacaccgcatccccttcctgaactttataattggctttcaccgcatttccgttaaccagcacacggtcttctttaatccactgctgtacttgagtccgcgaccaatccgcttcaactgcggtcaagtacttgtcaatccgttcacctttatgttcttcatgaacggtcatatcataatgctccatgttacagctccttcttcttctttccgtctaacagcatttgtataaataagagcaggactccgatgcataaagatgaatcggcaatgttgaaaatcggatagtgataattgacgatcgtcacgtggataaaatcgacaacttcttgtctgaacacgcggtcgatgaaattgccgacagcaccgccaagcatcaaaccgagagcgattccgagcaggatttgtccttttgcatgtttttgaatgtagtatacaatgccgatgatcaccaccgtcgtaatgatgtaaaaaaaccacatctgcccggccaaaatgccccatgccgcacctgtattcctgtgcgacgtaatctgaaagaagccatcgatgacggggatgctttcaccgtactccattttgctgacgaccagccattttgtaaattgatcgataccgataatgagcagcgcaattatgtaataaggcacaaaccgttcctccagtttctgtttctcttcatttaagcattttaacaagaaaaagaaaaggagtaaaggaatattcattgacatcctgcaagagggcaaatgccctcccctcttgcagaatgttatgagtagagcgcccggttgaacgtttcatccgtctcagcccaaataggaagcgtctttttttcaaattgggcatgatataaaaaatcgttcgcagtgcgcgccgtcggcagaatagccatctttgccagcggaatagcctgatttgtttcttcgcaaatgccgtatgttccgttttcgatttttgaaagggccaaaagcacgtcctgaagctcttcttttacatgatacataagtgttgcctgctgatacgaactgatgccctgagaatcctgctgaaaaaaggagtattcaaaaagccttgcttccaactcttccttcatttgaagaagttcggtatgaattgccgccagctgctcgttcacgcctacatcaactcctgctcttatcgtttgtgaccttagtgttaccgacaatgccggtatccaagcccaaaagatttttcctgacgtacaaaacgatgtcagcaatggcatccttactgcggactttcacaggatgtggcggcggcgttcaagcaggttagctgccgatcctttttatttacttagcaggcatgacagcaaatgataaggtttggcggcatgctaaaagcggttcggaaaaactccgaaccgcttcatggttaattttgataatacgtcttcacaattccagcacagcgagggcagagttccggatgatcgggatcctcgccgatttctttggaaaccatgcggcaccgctcgcaagtctcgccttctgcctgagcaacgacgatttttcctgtttcaaacgactgcgcatcctcaggcgcatcggcttccgttccgccgatggcaagctccgacacgatgaacagctgtttgacgtcttccttgattgaagaaagcagcgctttagcttcttcattcggatacagcgtcaagctggcaaccgaagattttccgatgatcttttcattccgtgctgtttcaagcgctttaagaacatcgtcgcgcagcttcatgaagctgtcgaacttctcttccgtctcttttgcattcggaatgtctcttgtttccggcatatctgtaagctgcacgcttttttccgatacgaatgtgaagtggctccacatttcgtccgcagtatgcggcagaatcggcgcgatcagcttgacaagcgcaagcagcgtttcgtaaaaaacggtctgcatgctgcggcggtctttatgatcggcgtgttcaatataaacgacgtctttagcaaagtccatatagaatgagctgagctcgatcgcacagaagttgtggacagcatggtaaatgaccgcaaaatcgtattcttcatacgcttttttgactttttcaatgaggctgttcagcttgatcaaaatgtactgatcgacttctctcagatcttccacagcgattgcatctttcgccgggtcaaaatcagcaatgtttccgtgaaggaagcggaacgtgttgcggatcttccggtacacttctgcgacttgctttaagatcgcgtcagacacgcggacatctgcctgatagtcgacagacgcaacccacagccttaaaatatctgccccgaactggttcatgatttttgcaggaacaacgacattgccgagtgatttactcattttgcggccttctccgtcaagagcaaaaccgtgcgaaagcacgcctttataaggtgctttgcctgttacggcaaccgctgtcgaaatcgatgagttaaaccagccgcggtattggtcagatccttccagatacaagtcggcaggtcttacaagatcttcgcgctcttccagtacggcctgatgagacgaacctgaatcaaaccagacgtccatgatgtcctgctcttttgtaaacttgccgttcgggcttccagggtgagtaaagccttccggaagcagttcattcgcttctttttcaaaccaaatgttcgaaccgtgctccctgaatagttcagaaacgtggttgatcgtttcgtccgtgatgatcggctccccgttttccgcataaaataccggaatcggcacgccccatgcgcgctgtcttgaaatacaccagtcgccgcggtcgcggatcatattgtagaggcgtgtctcgccccattcaggcacccatttagtttctttaaccgcttcaagaagctcgtctctaaagtctttgatggaagcgaaccattgggcggttgcacggaaaatagtcggttttttcgttctccagtcgtgcggataggagtgagtgatgaaatcaagcttcagcaaagcgcctttttcttcgagctgttctgtaatcggcttgttggcctgatcgtaaaacagtccttcaaaaccaggggcttcgctcgtcatatgtcctttttcatcaaccggacaaagcacgtcaagcccgtatttttgaccgatgataaagtcgtcttccccgtgtcctggagcggtatgaacgcagcctgtaccggcatctgttgttacgtgttcgccgagcatcacaagcgaatctctgccgtatagaggatgaactgcgacgatatgttccaaatctttacctttaacagtctgaacgacttcatgatcttcaaagccgatcgcttttgccacgctttcaatcaatgcgcttgccatcacgtagcgcgcgccgccggcagcaacgacgctgtactccagttcaggatgtacggcgatgccgaggttggccgggattgtccacggcgttgtcgtccagatgacaatcttttcgccgtttgttaatacgccttttccatcctttacatcaaatgcaacatagatagacggagagcgtttatcatggtactcgatttccgcttcagccagagcagactcacttgaaggagaccagtaaaccggcttcttccctttgtaaatatagccttttttcgccatttcgccgaatactttaatttgctgcgcttcaaactcaggcttaagcgtcacgtatggattttcccaatctcctctgacaccgagccgcttaaattgcgctttttggccttcgatttgctgccatgcatattcttcgcaaagtttgcggaattcggcaactgtcatttctttgcgcttcacttttttgttcttcgtgagcgctgtttcaatcggcaggccgtgtgtgtcccagcccggaacgtacggcgcatgatagccgctcatcgatctcgaacggacgatgaaatccttcagtactttgttaagcgcatgccccatatgaatatcgccgttcgcatacggcggtccgtcatgaagcacgaacatcggccggccttcggtacgtttctgaacgaggctgtaaatgtccatatcctcccatttcccctggatttcaggttcgcggttcggcaggtttcctctcatcggaaaatctgttttcggcattaagagcgtgtctttataatccattaccattcctccaaaacatcttttctaaaacaaaaaaagccttttcatcccataagggacgagaaggctttgatctcgcggtaccacccttttagacaagccgattcggcttatccgctcaaacatcgtaacgtgatgggacgtcctttcctactggacggttcagaaaggaaacttgagggctgatacacaacgattccaacaatcccgggcttacaccgcccccgggtcgctttcattgttttcaggaatcaatgtctgtccctctcaaacgtttttcactcaatttatgaacgtattatatgcgaacagatgacggtatgtcaagattgcaaacgaaaatctattccttttcatccattactgcgtctacttcgtattcaagcaaatgatcccagtcatcgtttttcaacaggtcaagctgcgcttcgatcagcatttggaaacgggttctgaacacttttgactgctttttcagctcttcgatttccatcgcgatctttctcgattttgaaagagactcattaatgatccgatcagcgtttttctcagcttcacggatgatgagcttcgcttctttctcggaattgcgctttacgtcttctgccgcttcctgtgcgacaaggatcgatttattcaacgtctcttcgatggtcgaaaaatggccgagacgctcgtcaagctcgttcacctttgtttcaagctcattttttttgcgcagaatgatctcataatccttcctcacctgggccaggaattcgttcacttcatcttcatcatagccgcggaacgctttcgtaaatgttttattatgaatgtcatttggcgtcaaaggcatgctgcccacctccatttttttctttatgtacacttgtcctagtcaacattataaagcaaaattcgaccgggcggagaaaaaactgttaaaacgcgtcatttttgtttttcaaacgtcaatctccatttgcccttcttcgttttgccgtcaatgtttttcattctgaagcggccaaatccccggatcgaaaccatatccccttcagccagtgcatatgaagggtcttcgatgactttccagttcactttcacgaggccgtttttcacaagaacctgtgctttctgccgggattgcctgctcattgccgagcaaatcgcatcaagcctcaaagatgaaaccgtatcatcccttatttcgacatcctgctccggtactttaagctttgaaagcggaattttttcaagggaaactttcaccttgccgatttgtgtcagctgggtgaaaacaaaatcagcgacttcttccgaacagataaactgccatgttccgtccgaaaagatcagatcgccgaacttttggcgcttcaatccgatgcccatcaatgagccgagaagctcgcgatgctcgatggaggcaaatttttgcgggtagatgacttcccaggcttgaagctgaaaatcttcggcagacggctcggcatattcggggaacagcacagcccgctttcgttcagcctcagggaaccccccgaaaaattcaagcctcacttcgtccgactgaccgatgacagactgcaggatcacctgttcccgcggatccaaaaaatcggtcagcttcatccggtactgttccgctacgattcttttccactcaagagcctggtcgataaacggctcttcgtcttttctgaaatgctggtaaatatcgctcattgtctttcctttctatgtaaagaggcctggctacagccaagcccgatactcggcccgcaaagattgaaggcacactcatgaaaagcggcgccgctgccgccggcaagtccttacgggaaatcggcatgatctcaattaaaaagcgccgagcattctgaaaaccgcaagaagccctgcatctgcgaatttcaggacgaaaatcgccacaatcggagaaatatcaatcatcccgagcggaggaatgatccttctgaacggttcgagataaggctcgcaaagtgaagcaagcacccggccgaatgaagattcccttgcattaggcacccaagacataaaaatgtaaataatgagcgcaaaagaatagacggttaaaagcgtgcttaaaatttgataaagtaggatcatctgcgatttaccacctctgatgttcttcttctatgagctcggaaatcgtgccggaaacatcgacgttctcaggcgtgcataaaaagatgtccgctccgatccgctgaatatcgccgccgagagcatatacagttccgctcaagaaatcaacgattcttttcgcctgatcgtgctggatgcgctgcaggttcacgacgacggcgcgtcggtttttgatatggtctgcgatttcctgggcttccgcgtacacccgaggctcacttaacactactttagaagatttctgaacgctttgcaaacttacgacattctgcttcccagccgctttagactggtaggcggttctgtcttttgattcatgctcttcagggatttcctccctgtctgtttcaatatactcgtattcgtattcctcatcatccaaggaaaaaaagtttttaaatttgtttttcaaactcatgattgtccacctccagtttcatttccgactaaggaagatccgattctgacgaatgtcgcgccttcctcgactgcgatcgcatagtcgttagacatacccatcgaaagctcgctgcacggagcgttccattgatcaaggccccgcacctcgtcgcgcagctctctcagcaagcgaaaacagcttctgattgccttctcatcatccgtaaaaggagccatcgtcattaatcccgcgatccgaatgttttcgtatccagacagtttttttacaaaaggaagaacttcttcttttgccatgccgtgttttgaaggttcaagggatgtgttgacctggacaaaacagtcaatcggtttttttgccctcttttgaatttcatcggccagtgaaagcctgtctaaagaatggatatatgagacatgatcgatgattgcttttacctttctcgtctgcagggttccgataaaatgccataccggttcgctgtctttcagaacgtcgagcttgtgaagcagcccggtatcacggttttcacccaaatgcctgattcctgcatccagcgctgcctgcgcccgttccggggaaacatatttcgtgacagcgatgacggatatttcgtcgggcgttctgcccgctttgatacacgcttcgttgatcctgtcatttatatgtcgtaaattgctttttacatccacctgtaagctatacctcctttaatccgatgaaggacatcatccgtccggtttttccccggtctctccgatgggagaaaaacagtgaacgctcgcagctcgtacaaagggaactcacttcgatctggccgtttggaattccggcgtgtacaagcagctgcctgttcacttcttttaattcgagacggtactccccttcttttatcgtcaaaaaggctttgtcttcttgctgaagaggaagatttctgattttgtctattacatgatcgtcgacagtgtagcagcacgaaccgatcgcaggcccgatcacggcacggatgtctgcgggattcgacccttcccgcctgatccacatgtcaaccatgctggcggcgatcccaagtgcggtgcctttccagcccgcgtgagcgatgccgaccagcgagcggaccggatcgtaaaaataaacgggaacgcagtcggcaaagcaaagcgccaaaaacaggtttggcctgtctgtataaagtccgtccgtagccttcagcgccgtatcgtatcggaaagcgccgctggcgcgatcgccatccgtcactttatgaatccggtcttcatgcgtctgatcagcaaatacccagtcgtgcagatctgtttttaggatgtcggcaaccttttttctgttattgatgacatgctgttcatgatcctgaacgtgcagccctgtattcaatgagtgaaaaggcggttcgctttctccgccgttttttgtcgtaaatccggctgtgacggctccgccggtttccgccgtctgattccattcctcaatcaaaagcattgacggagcatcaagacgaaaggggttatatgtattcatggtgatcagcctttcgacaaacatcgtagtctttcatcatatcgctcctattttaacacatcttgatgcattcgtttagtttcgtttcaaaaaactaaacgaaatgtattgtttgcaacatttatccctgcttttgcagacgttctcatcgttcacaacattttgaaaaaagcaggcggataaaggtccgccgattgatcaggcagcatctgattgtgctagatcagcttaaacgcacaagaatcacatcttctccaattttaacaatatttcgccacggaatgacgatttcctcttcttttccgaaaaatccgaaaactttccccgttcctccgatgacgatcgcctgtattttgcctgtcgttacatttatatcgatatcgccgatgctgccgagcttttttccgtttgatacgttaacgacatcttttatctggaaatcagaaatattcatcatgtccaccgcacgcctcctctgatcaaatgtccttttaagattatatgaaaggcagtcctttatttagactgccttttcagtggtttatttcgtttttttcctgccggctaaaatatcgagatggacggtcataacagcggattccttctttagaaaggcattgatccgctccttttgcgcgcgccatgataaaggcgtcatcttgatgagcggcgggagctggattcggtctaaacgtttgctgtaggcgatctccgttctgtcgatcagatcaaaatgagacgcgaagcgctcagccgtatcctcgctcgtataggcttgtttgtccgagccgtcgtacaaaaatctcctcagttctttcagatggccgcttctcggaatcactttcaaaacgatgccgtcatccgataacagccgctcgaattccgcgtaattagaaggcgacaatatattgaggatcgcgtcgaatgaacgattccgaaacggtgcggcagccagatcggcgacacaccagatcgcctctctttcttgcttagccgccgatacaatcccggctttcgccaaatccagcccgactccaaggacaggcgttccgaaacgcgcttctagcgtttcagcgattcgcgtcaaatgcgaaccttccccgcagccggcatcgaggatcctgacaaaattgcaaaacggcaggccggcttgtttaagacggtctgtcaacgcgcctctcatcggttcaaaaaagccggcggctgctaacattcttctcgcttcaaataattctttatcatatttaacagaaggagcatgcgtcgtgacattgacatatccctctcttgcgatatcaaacgtatgtccgtttgcacagatcaggctttttaaatcggtgaccgccatattcgccgcacatatcgggcactgaaacatcgtttcgtgcctcttcatgagcgatgctctttttaattttttattcatcatttttacacctcattcattcacatttagatcaatgaaaaaggcatagacaaataaacccgctccttcggcattttttaaagacgaaggtgtggatggtttaagcgtttgtctatacctttcattatctgtagcgaatgaattgaatgatcataatgatgaacccctctttaacatgatgttctctattatcttaccagcttctttaagatgaggaaagctgaaaaaagcctccaaacaaggaggctgccaaagaatcagcagttttaaacgctgaggtttagaggctttttcttggacaaatacggtctgccgtccgtccataccgcctggacgggcatatcgaaaaattcggacaaaacctcgccggacatcatctctcttgtctcccccaaggcaaacacttcaccttttttcaacagcagcgtttggctgaaagcggggagaatttcttctgcatggtgagtaacataaagcatggacggtgcactgtctttttttgcaatttgttcaaccgtctccagcacctgctccctcgcgatgaaatcaagaccggttactggctcgtcgagaatgagcagctctggatcggccatcaaggcccttgagatcagcactttttgcttttctccctgggagagcgtttcatatctcctgtccgcatagcggatggagccgaattcctccaggagggcgatcgctttctccctgacagactgtgaaggcgattcataaaggccgatcgaagcgaaagcgccgcttaaaacaatttcaaatgcactgtcttcaggataaagcttctgctgcagggcggctgaaacaaggccgatttttcgccgaagcttctcgccaagctccgtttttccgaattcgcgccctaacacggtgacttttcctgttgtcggaaaataataagcgcacagcatattgagcagtgcggttttgccggctccgttcaatccgtataacgcccagtgctcccccttttccaccgtccaatcaatatcctttaatatccactctccgtttcgttttagtgaagcatgctcaagctgcagaaccacttaaaatccccctttttttatgtaaatattctgataaattaaaatataattcttttattatagcttatatatttaataaagtgaatgagagattttccatttttagcatgtgaaaagccgcagattgactgcggcttagtgaatgttcttattcatttgtttaatggcggctttttccagccttgagacctgggcttgggagattccgatctcatcagcgacttccatttgcgtcttgccttggaagaagcgttttctgaggatcattttttcccgttcattcagccgtctcatgccttcttttaaggcgagctcttcgatccattgcgaatccttgttgcgctcatcgctgatttgatccatgacataaatcggatctcctccgtcattgtaaatcggctcaaacaaagatacaggatcttgaatggcgtcaagcgcaaaaacgatttcttcatgggacacttcaagctctttagcgatctcctgagcagtcggctccctgcttgtctcactgatcagccgttctctcacttgcagcgccttgtacgcgatatccctgagtgaccgtgagacgcggatcgggttgttatcgcgcaaatatctgcggatttctccgatgatcattggtacagcatatgttgaaaacttaacattgtggctcaggtcaaaattatcaattgatttcattagtccgatgcagccgacttggaataagtcatcaacatattctcctctgttgttaaacctttgaatgacgcttaagacaaggcgcaaattgccgttaacaagcttttctcttgctgttgtgtctccttcatcctgcatttgcttgaataactttctcatctcttcgttcttcagtacgggcagttttgatgtatcaaccccgcagatttcaactttattcctcgacacttttttccctccctacaggagctgctgtacaaagttcagtatctcctcgggtgggaaaaatatgcatcgttaatttccaaaaataagaagatcgagccgaaaacccttgactgtcaatgcttcaaatttcataaaaaaattaaaccatcttgttgaattcttttcggagccttttaataattcttttttcaagtcgggaaatatatgactgggagatcccgagcatatcggcaacgtctttttgtgttttttcttcccctccgacaagcccgaaacggagctccatgatctgtttttctctgtcattgagctgttcaagcgcttttttcagcagcttcttgtcaacgtttgcttcgatgtcttttgtaataatgtcgttttctgttccgagcacatctgagagaagcagctcatttccgtcccaatcgatgttcagcggttcgtcgaatgatacctctgaacggattttattgtttcttcttaaatacatcaaaatttcattttcaatgcatctggaagcatatgtagccagtttgatttttttctcgggattaaacgtattcaccgctttgatgagcccgatcgtgccgatggagattaaatcctcgatattgatgcctgtattttcaaattttctcgcgatgtacacgaccagtctgagatttcgttcaatcaaaatcgctcgtgccgcctgatcaccgtcaggcagcttatggagaagcacctgctcttcatcttttgacaatggcgggggaagcgcctcgcttccgccgatataataaatttcgtcgcttttcagccccagtttcattaaaagtttgtaccatagataggttaaccttaattttagttttttcatcttcctcccccttctaaataaacgtcttcaggagtatgataatgtaacagacttcaagtttaagaaacgtgtttgaccgggtttccggccagcattttcggatggacgatggcgtcaaattcgccgtcagcggaaagcggtgatgtgctgatgccaatcaggcatttcggcgcttcaatcacttctctttccgtacaaacgagcacatgatccggctttaagcagagcagaaactgatgctgatggccgaccccgcggtacggaatcaggcggatccgcccgatatacggcagtgcttcatccagtttcccgacggcatcaagcgggctcatttccttgatggtcacacttgcctcttctcccaatacaactttcaatttttcaatattgacgatcatgacgggcgtttttgtgattggatcgtagagctggtttccggagtcaatcaatccggtgaaatgaagcgtatgttcaccaatgcaggcctctaggcggacgcgttcttcgtattgaattttcttcgcttcagcatcttcaaaacgcttttttgaaaacagccatacagccgcaaaacccacacagacaaacagccagctgacggggtctccaaaaccggaccaattcgtcataaagacgccgttttccatgatcgaatccgtttcaagcaaagaatgcgctccgataatccctcctcccattaaaaaagtggcaaaataaaaagaaaacaaattctgcaaaaaaaaccggaaccgcttaaaaccaaatgccacaagaacgatcacaaccgaaaacgacagtttgccggcaggatgaaggacgtacggtgaaaaaggtgtaaacataaacagaactatgcttgacgcgacaaatgcccctaggatcagcctccgctttttaacccttcgctttaaaataaatgcggtcatcattaaaagcagcaagtcaaaacaaaagtttaacagccatatcgcatctaaatagatttccacatccttcccctttctgcggctcggtgaccttagtgtttgttttcctaagtataaatcaagcccaaaggtaaagtctgtcaattaatgttgcgtaaatcgtacattttttgaagttttcgtactgaatttgtcgatcgtaaaacgaaaaaaacgctgccattaaagacagcgtcttttcacctttatttcagcttttcattgatatacagcttgccttttgccgtttgtctcgtttcattgccgtaatcatctctgacgatgacctcgatttccgctccttttgcttttgcagttgaagtagcggtccaatatccttcatattttccttttgagacttctctgatcggcagctccgttacgttttgggcagcggttttgaaattggtcagcggcattctgatcacaaagacagcatccaaatcagcggcgctttcaaactcgattttcacggtttctcccgttttgagctcgagatcttcggccggtttcaagccggtgatttgcggcgcttcaaagttgacatctaccgtgacctttttggtcgttttgttgcctgccgcatccgatgccgttactttgatttcatttttgccgttgtcaagcataatccttgcagaatattcgccattgtcaacagctgcttttttgccgtttacatgaacagattctaagtgatcgtctgatactgttcctttcacggtgacggtctctttattgagttttgagccgctttccggcgtgtcgattgtaagcttcggctttttctggtcaaggacgatccggaccggttctgaagcatcagtcgttccggaagccgatgacgatttcgcggtgatgacattttcccctttattcaacggtatttcttttgagaaagtgccgtctgccgccgtttccgctgttccggcttcttcatccccgttaaagagatgaacggtcgtattcggcgaggatgtcccttcaatgacagcgttcttttggttggtgatgaatccgtctttaggagacgtaatcacaggcaccgacaattcatagtcgaccaaagcgcggatcataaagttgccttggtctgatggcgcttttgaccatgagccgtccgtatactgccagttgcggccggaatattctccgtcttcgtctgtagcaagtccaggtgagttggccagatcctctttctggacgtatacgaggtaaaagtcttttccgacgatgatgccttcgtcacctaaatcaacggtcgtccattcgcctgtgcggagcgcttcagccttgaacgggccggcgatttttttgcccggagagcctttttcacccgaagcatcatagacctctactgcaaaatcagtgccgcccggatcagggaattctgtatcccagaatttaaacaaaccgcctttcagcatggctttttcctgcccgttttcaagcgtcattttaacggccagcccgttgccggattcatagaaagcccaggcgttttccccggttccgtcatcatagcctatttcccccggatagccgatgaaaggatcgagatcgatatctttcgagacatcgccttttaaatcaacggaaaactcgctgctgtaatatccgtttgcagagacctttaccgtatacgagccttcataggccgttaatgaatagcttccgtcatcatccgtctggactggttttacagctgcatcttcaacgatatacaactttgcatgccggacgggttcgcccgtttttttattttttatcgttccggtgagcgtccctttttttagttcttttaaaacaaagtctgccgttgttgtcttgtcggactcgatttttacggtttgggcgtttgattcatatccgtacgcttccgctttcagcgtataggttccaggtgcatgagccaagctgtatgcgcctgttgcctggttggaatatgtcgatttgcccgtttccagcacgctgacctgagcgcgcaccggaagaaccgcaggagctgcttttttcgtttcggttttttcctgaagggcttctgccggttttgcttttttcggatcaatcattcgtttctttgttttcttatccttcattttggccggctgtttttcaacgcccaatcgttttttcgtaccggcgctcttcacttccttgacaagcgctacatcatcgatgtacagcccgtcaccttcaatgctgtcgtcagattgaaggttgaacatgaccttaatcgtctgtcccccgtattccgacaaatcgatctgtccgtctttccattctgatgtcttgccgctgtactcggcagccgggatccattcaccttttccttcaggctgtacgtaaacgaagccgtaatcaaagtcctcttcaatatcgtgccaatatttgtatgtgagataaagcttttgattttttggaacgctgacaggaggcatgagaagattcatattagccgaactttcatacggccctgtcagatttgttgcgaatacgttttttcccgatgctgcggcgttcgggcctgactgaggaattccgcgctcccatgaattcttcacgcctgatgtgagccagccgctggcggaattctcgaaatcttgtttataccctgttgtcacagccggggaaatcgggacttcgtacactttggattccgttttgttgcctccgaaatcggtgacaatccacttgtaggaaagggttttcccttcagaaacagttacagccgcctcgtacgttccttttttatagtcgccggaagtttgtttggcagcgatcgtctcccaatcggcgtcatctgttttatagctcaatttgaccgatatgatgctgacatcgtcttctacctcagctttaagaggcgttttcgagcctgagtaaatttcggtgatctcttgatggtttaaggccggcggacttttgtcttcgccttcttttccgacttgtccttccgctctgcccaacccgcctgtcacagcggacactgcgtcaaacacgttcacgagtccgtggccgtatccgttgttcggcgattcggtaaatttgctgtctgtgagcggtgttgcagtttccatcaaaatcttttcggtctcatcaacagtgatcgacgaatcggcttgcttgataagagcggcggcggctgcgacatgcgggccagccattgaagtgccgtcccagccgtcttgatagccgcttccaggcacagatgagcgaatgttgacaccaggcgccgatatttcaggcttagtctcatcatacggggaaggaccttgaagtgaaaaatcggctaagcgattatcgatgtctgtcgctccggttgcgaacgcttcagggtagtttgccggattggcaatcgaagcaggtcctcccggattggcgaaatcgacgttccccgcagagaactcaggaaagatgccggcagctcgccacgcttttacgatatccctgtaaaactcatcaatcccggctccccctgaccatgagttattgacgacatccggcgccatttcagggtgcgggttgccgtctttatcttttggcgccaaaatccattcacctgctgcaataaggtcttcgtccgttccgccgtcatctgaaaaagctttcacagcaatccacttcgcacccggcgccacgccgatttggttttggccgtcaggctctgagccgaccatcgtcccggttacatgcgtgccgtgctccagatcgtcaaatggttcagaagcgcctgaaaccgcatcataccaactgaattcgtggttaggctgatcgggatgcttcgggtcatatccgcggtatttttctttcaaggccggatgatcccactgcacgcccgtatcaatcgacgcgacaaccgtgcccgatccgtcatatcccaatttccaggcttttggtgcgtcgactcgattgatattccattcgatttctttttcatccttggctgctgattttttcacagactgtttagtcggtttgatcagctgccttttttcgttcggaagcactttttctacttccggaaaagccgctacttgttccatgacctctttcgtcgcatggacggccatgccgttgacaatataataggatctgattttttttacgttcccctgtttttcctgctttttcaaataacgtttcagatcgctttgcgactcatccgctttgactcttaaagcggaaacaacagccgagcgtttttgatattctgttttagcagcgctcagcgactttttcttcgcgttcttttccgcctgtttggccacttttggtgtatcgacttgatctttcagtttaatcaaaaatgtgacttgatcttcttttttgaactgtttgacaagagtttttgaaattttccccttccctgcggctgcttgttctttcatggaagtaagtgcgggctttgccgcggcatctgaaacggcgggcatgaacagcgagccgattaacaaaccgcttaaatggaaaacgccttttttctcagctttcttttcaaatgaacatcccccttttttatgaaattagctgaattttcctgtccccccctccttgtggacgccttgtctgactttgatgtaacttaaatatagtaaaaactggttaattattttgtcggtatttgtcaaggccttgtttaaaattagataaaaaaaggacaaaaccgcttaaaggttttgtccttttttatcatttagttttttttgctgcgtcaaaagcttttaaagcgttgaccaagccgtatccgtagccgttgttcggggattttttaaacgttttgtcagtcagaggcgtcgccgttttcagcaggatgcgctcgatttcatcgactgtgaggtccggattggcttccctcattaaggcgacgatgccggatacatgcggggtcgccatcgatgtcccgttcattgcagcatacttatgtcccggataagcagagcggatgctgacgccaggtgcagaaatatcgggcttgatttcgtcatatggcgaaggcccttgcaatgaaaagtcggctaacgcgtttgagctgtcaactgcgccaatcgcgaaagattgcggatagttggacgggttttcaactgaacccggtccgcccggttcgaattcgctgacattgcccgctgcaaatgcagggaagatatcagctgcccgccaagctttgacaatatccaaataccattcatcgagtccgcgttcccctgcccaagagttgttgacgacatcgggagccttttcagggtgcgcttttcctttcgcatctttcggggccaaaatccattctcctgcagccaaaagggatttttcatctccgccgtcctctgaaaaggccttgacagcgatccatttcgccgtcggcgcgacaccgatctggtttttgccgccggcttctgagccgaccatcgtgcctgtcacatgtgtgccgtggcccaagtcatcatatggcgttttcttattgcttaccgcatcaaaccagttgaactcattgtctggactgttcggtttagaagggttgtagcctctgtactttgttttcaacgccggatgatcccactctacgccggtgtcaattgaagcgacgacggctcctttgcctttatagcgctttttccagacatccggcgcatgaacctgctcaatgttggaagcaggggtgcgatccgcggttgttttcgattctactgtaggtttttcggtattgcccagcttgattttttgattgggcagcaccttttcaacctcaggaaatgaagccgctttttccataacatcttttgtcgccgtcacggcgatgccgtttacaatatagaaagattccactttcttagctgttccttttttctcttctttttccaaaaacgatttcaaatctttttgtgttctttcagcttttgtacgcagggaagtcagcactgccgagcgtttgatctcttttgcttttttcacggtcataacgcttgctttcgcccgtttttcagccgcggttgccgcttgctgaaggttcgcctggcttttcattttaattaaaaaggtcactttaccttctttctcaaaacgtttataaagagcgctagatattttgctttgttcctttgtcttcgctgccgtgcctgtatcagcctgcacagcaaccggagcgagaagtgaaccgatgagtgcagcgcacatgaacgtgcggaataatggctttttcttcacatgacatcctcctttaagcaatagcaaatatagtcgtttcttgcgtttctatgtctagaaacagaatctattaataatggtaatagaaaaggtttatagatattgtcgtattctgtcatttttcctttgtcagtttgcaaattcgttctttttacatatgacttgttcaccgttcatagttcggcctgatgacaagaaaaaaggaaaatctgtacattcgggagaaaagagagagattagatgcaaggcttttgagggagccgcttccatcaagaagacaattgatgcttttggaggggaaggaacatcggctgctgttccagcgcgcaaaaaaagccgccgacttcttgtcggcagctttccaatgtattgtagacgtttagcgtttattgcggtttcttaagaaagtcgggatgtcaagcgtatcctcggcaggctgtgatgggctgcgatgcggcatgcttggctcctcgcgcttcggctcccgtttcggagcaggctgatgatgctgttttaagccttggtttaaaggtctctgcggctttgatgaatcttgatcctgttcgataaatccagtcgcgatcaccgtaacgacgatctcgtcttttaagttttcattgatgacagatccaaagatcatgttgacgtcctggtcagatgcagctgcaacgatgtccgccgcttcctgaacttcgtataggcttaagttggtgccgcctgtaatgttcatcagcacgccttgggcgccgtcaatcgccgtttcaagcagcgggctggaaacagcttttttagcggcttccgcagcgcggttttcgcctgtcgctacaccgatacccatcagtgcagaacctttgttggacatgatcgttttgacatcggcaaagtcaaggttgatcagtccaggcgttgcgatcaggtctgaaatgccctgaacaccttggcggagaacgttgtccgcttcacggaacgcttcaagcatcggtgtgtttttatcgacgatttcaagaagacggtcattcggaatgacgatcagggtgtcgacggcttccttcattgctgaaataccgcctgcagcctgaagctgtctttttcttccttcaaaggtaaacggccttgtgacaacgccgacagtcaatgcgcccagatcttttgcgatttgtgcgatgacaggtgccgcgcccgttcctgttccgccgcccattccggctgtgacgaacaccatatctgcacctttcagcgcttcttcaatttgttctttgctttcctctgcggcttttttgccgacttccggattggctccggcgccgagcccgcgcgtcagcttcgcaccgatctgcattttcgtttccgcttttgacaggttgagagcctgagcatccgtgttgactgcgataaactcgactccctgaacgtcattttcgatcatccgattgacggcattgttaccgccgccacctactcctattactttaatcgatgctaagccgtctatatttgtttcaaactctaacatgctaaatcctcctaatccgtcgaatgactaatctctattcccaaaagaagttaaatattttcttcattttgctcggctttttctcagcttgagcctgctgcttggattttggcttcggtcgctgctgcacttctttttgatgagttgccgcgacttcctgaaccgcttgttccggcatcttaaaccctacttttctgccttggatttttgcgttgcggtaagcgaattggatgaggccgactcctgtcatgtattgaggttctcttacaccgatataattcgggctagccactctgacgttattttgaagaacatcctgtgcgaggctgaggacccccggcattccagcctgtccccctgtaagcacaaagcctcccggcaattcttttattcccatgttccgcagttcctctgccacgaataaaaagatttcttcaagcctggcttctataatgtctgccacttcccgctgagtaaaggtctgcttttggtccgtcccgatcacggcgacttcaaatgtttcctcttccgacgcttcttcgtagaaagcatgtccaaactgctttttcacccgctcagcttcgtccgtggaggtgcgcaatccgattgaaatatccttggtgatgttttctcctcccagtggtatgacacgggtcgcaagaaggtggccgtcctcaaatacggcaaccgttgttgatcctcccccgatgtcgattaaagccactccgaggtttttttcgtcctttgataaagcgacagatccggcagccagcggctgaaggcaaatatccgttatttcaattcccgctctttccacacagcggagcaggttatgtaaaatcgttttagagcccgtgatcagcgatccttccacttcaaggcggacgccgagcatctttttcggatctgtaatatcgcctcttccgtcaacgataaactgtctcggaatcacatcgacgatcagctgttcaggcgggatggaaacgacttgagcggcctccatcacccggcgcacgtcttcaacgtggatttctttattctcgcttgagacagccacaacaccgttcgtatcttgaatatggatgtagttcccattaaccccgacgatcgcgtgggtcagcggaaaacctatcattctttctgcttgttcaaacgctttttttatagaatgaaccgtttcatctatatcaacgattgatccttttttcagcccctctgagggaacatttccgactccgataatgttaagagaatcgtctgacatttcaccgacgatcactttaatattggacgtaccgatgtctagactgacgtaaagttcattgttgttcattctatggcacctcctcacatttcagtcaattctattctattatttgccgaacaacaatacaatgaatctggttttacaagtgtgtaacaatcaatacaaaccaatacgcttcgttttcagttttaggattactgtgaatattcgtgatatcctatgtatatcctcttttaaatccgattttttttaattttttctcctcgatgccgtccatttggcgagcagtattcttctgatgaccgcgatgttttgaaaaagcctcacgccaaatgcaaacataccgactaaatacaagtctacaccaagatgaacgcccagaaaagccaaacttatggcaagaataatattgaagaaaaagcctgtcacaaaaactagttcatcgtatacactttccaaatgggcccttattcccccgatcaacgtatcgagcgatgccagaatcgccagggacaaataatttgagtactcatccggaatggtgaaattcgtgctgaacccgattgtaattccgagcaaaagccctaaaaccggaagccacattaggaattctctccttttgatttttcgagcggtttcaatggcgcaacttgcattgaaccttcgtaagctttgattttgatttgtttttcaggccttttgatttgcaaatccagattttctcccgcgaacagatcctgcagggatgaagcattcattcggctatatagtttatcggcgtttttgccgatgacttttaccgttatcggatagttgtccaaaggataaccgtctattttggttgttccgttgatatcgcggatcaccgtcgtgttgacaacccttctgtcgttgatggatatttcttccgcttcatacatattcagttcattaatcagctttttcagaaggtcgggagggggattttgaatcgattcccctgtcaattcttccgagaagagctgagaaatggtgatgatgattccgttccctgtgacatctgtgaagccggcctgtttttttaagttttgaagcgtttcattcaacgcttttgtccgcgaggtttcttcttgatgactgtatgtgttcagcattttttcatacttgtcaatttcgctgatcagatcaagctgttttttctgttcttccttcaagtcctccctgaggtcccaaatgtcccgcgtatcgcggaccttcggcgccttcagcgaattgaactgcacggacagcataatgccgaaaatgagcatcaagatgctcaaactgatgaaacgattatttttcttcaatgtccgcccaccaacttttcaacgttcattccccttgcttcaaaaggggctccatctcgatattatcttgtttttcgatgctgactgaaatatgatcgcggctcagctggtccacaagccctcctgcaatgttcagcgccggcatcagcacatccgcatccccgatggccgaaataacaaacggcgccggatactggttgccgtcaaccgtgatgacagggccgttgcacgatatgtaggaatgatgtgtcacgcgctgtccgttgatcgacaccgcggccgccccggaaatccacagctcattgagcaggcggaaaatgtggctttcatggacgatatagttgttgacattctcaccctctgggatgtacgaagcgtctttcagcgtcactttgatcccttcgccctgaacgccgatttccccgacgaacattctgtacctctcaacatcttccacaatattgtagtactcttttttttcctttttcaaagccgtctctgttttctgtacttcctgctgttttttgtaaagctcctgttccagcttcttattttgcttttcttgggaaatcagccggtcgcgcagggaatattcctctttccaattttcagcagtttcttcatggtctttgttttccctggcgaattgataggagaaagacagcaggaagccgaggacaagcatggcgagtgaaagattgactgtgtgcctcttcaatttccgtctccctttttgctttcatccgtttttttcagaggttcaaaataagtcgcgacttccatatggataatgcctttttcccctttcggcagctcttttacgatcgccggatagctgttcattttctgtccgaacgttttcagcgaagctgtcacgatatagccgtcgttcatatacagtttgatcagccaagggtttgatttttgaggcgtatagttgatctcggaaatcgattttttcacggaatcggaaagcttgttcagctgttttgccatttgaacgagcttttcgtcttcctcccagttattaagggttggtccgatgtcagtcggcgtcacctcttcaggaagcaccgtgccgttttcaagcacggagtagtacacattatgtttttgcaaaaacgcaatgcttttatactcttcgatggagatggcgattttgttgggcagttgtttagaaatttcggcttttttgatcagtttattctgctcgatcttttctgcggctttttgcttgctcagactccaaaattccgtctgtcctttatggattgaagaaagggaaatgatctgttcctttgaaacgtttttgtttcctttgatctctaccttcgagactttgctgatcggcgtctgcaggtaaatgatgatcagcatcatcgtgaaaaagagcagaataaaggtgatcagccggcggtttgccttttgctttcgctgttctttaattttgggaatacgttcttctatattcactactttttctttatcaataccgggtttcacgtaggctcacctcaggttaataaagcagacaaaaagacttttatttgcttatttttgttcgaaaaaagacgcgcttttcgacatatgaaagcacgggggcaagctaaaaagcttccgtttagcgaaacaaacgacatactaggatgccgtttgcttgtttgtttcatacattatatcataaggcgatctgaagtagagaggccgtttaccgtttttctccgataatttcgacctcagtgtgcatgtcgatatcgtatttttccttaatcgttttctgaatgaatgcaatcaaatcaaggacgtctttcgctgttgcgccgcctgcgttgacaatgaaattgccgtgcatctccgaaacctttgccccgccgatctgatggcctttcaaaccagcctcttcaactagccggcccgcatgttcaggcagcgggtttctgaagatgctgcctgcgcaagggttggacacaggctgcgtttcttttcggtagtctttgtttttctgcatctgcgcgacgatctgatcgcgttctttttgctccaattggagaacggcttcaagacaaatgcccggccgcttgttttgaaggatggatgtgcggtagctgaacgccatctcttcattcgtcagccattcgatcgttccgtcttcaaaaaggatcaatgctttcaccaatactttgctgatatctgagccgtgggcgccggcattcatgtaaaccgctccgccgaccgaaccaggaatgcctgcggcaaattcaaggccggaaagcccttttttgctgatgcctgtcgcaagccttacgacagagtagccgccgccgaccgtcacttgctcgccgtcgatttccatatggtcgagtccctggccgagcttgatgacgacgcctcttatcccttcatcgagaacgagaagattcgagcctctgccgatggccgtccacttgacgccgtgcttcttgacaaccttcatcgtatctttgacagcttgaatgtctttcggaatcaccagcacgtcagccggtcctccgattttaatcgttgtatggttgctgagcggctcgttttccagaactttgccgacttcaagttcttttaattcttgtatcaccttatccatcgaaaacctccacaatccttctgtcttatcattttgcatgatgtttcaattctttcagcacattgtacaagcgttccgcagcgtccggcacgccaagcgatttcgcgcggatcttcatctcttccaacgtcttttcgtcttgtaaaatatgatcgatcgcctgaattaagcggtctccattaagctctgattcttttaaaacgacagcggcgttctgctccccgagtgagcgtgcgtttacttcctggtggttggccgtaacatacggactcggaatcagaacgcttggaatgccgagcgcggtgatttccgctattgtcgttgcccctgcgcggcccacgacgacatcgaacgcttttaagtactcgggcatttgatggagaaacggctggacgaccatattcggagcggcgccttctttttcaagcgcagctgtgactttatcatagtgaacttcccctgtgacataaagaacctggtaatcccgcttttttaattcgttttgcatcgcaatgaccgcttcattgatcggagcggcaccgcggctgcctccgaaaataaggaccgtttttttgccctctgcaagacccaaagcggtcagggaacggcccccttttatagagacgacttcagacgccctcgggtttcctgtaaaaacaactttttctgcaggaaaatgtgttttcgcttcatcaaaacaaatcgctaccttatcaacatatttggataaaaacttattggtgagtccgggaaggctgttttgttcgtggataatcgtcggaatccccagttttgaagcggcgtatacgacggggccgcacacgtagccgcccgtgccgatcacggcatccggcttgaaccgttttaattcttctttgcattcttttacaccctttaaaaagcgcatgacggttttgacgttttcaaatgaaagttttcttttaaaacccgtaatttcaatcgctttgaaagggatcccttcccgctcgacgatatttttctccaggcctttttcggttccgatatataaaaactcaacatcttcgtgatgccgtttcacttccttaataaacgcaagggcggggtaaatatggccgcccgttccgcctccgctaacaacaatccgcatctgttctcccccttaatccttatgtacacgccgataaccctgctatctcgcaacagggttatcgccaaaatctagtatctagaatacctgctgacattcagcagcacgccgaccgccatgagcatcaaggtcagtgatgaaccgccatagcttaaaaacggaagcgtaatgcctgtaacaggaatcaagccagtcacgactccgatattgatcataacctgaatcgctatcatcgaaatgacgccgacggcgacaaaactgccgtataaatcgggcgcaccgagcgcgattctgatgcctctccataatagaacgctgaagagcaaaagaatcagcgatccgccgataaagccgagctcctctgataaaatcgcaaaaataaaatctgtctgcggctcaggcagatagaaaaacttttgcctgctctggccgaggccgaggccgaacagcccgccgggccccaccgcataaagagactgaatgatttgaaagccgcttcctaaagggtcctcccaagggttcaagtatgaagtgatccttttgatccggtacggcgccgacagcacaaggccgacaaaaccgctcagtccgatcaggccgagaaaaacgaagtgcgaaattctcgcccccgcgacaaagatcataatgatgcatgtgccgaccatcacggttcctgttccgaggtcaggctgcatcatgatgatcagaaaagctgaaaagacaatgcccagcgccggcacaaagccttttctaaacgacgtaatattcttttgcttttcagataaaaacttggccaaaaatgcgatcatcgcgagtttcataaactcggacggctgaatgctgaaagcgccgactccgatccagctcctcgacccgttccgttccatgccgatcccgggaaccaggacgatgatgagcagaaagaaacatacaatgatcagtattttcgcataagtcctccacgtccagtagtcgacgttcatgatgaaaaacatggcgatgaccccgatgccggcaaacaaaagctgccgtttcgcaaagaaaaaggagtcgtcgtatttgtaagtcgcccatactgcactggcgctgtataccataatcagtccgattgttaaaagcaatagcgtaatgataaccagcaaaaaatccggtgacgttttttttgtttgcaaagccgaacaccccaagctctaattcttagggctatctttacgagacaagcccttatttaagcatatgcacggcgtttacaaacatgtcaccacgttcttcaaatgttttgtactgatcccagcttgcgcaggccggggacagaagaatgacatctccttcgtctgacaggctgaacgccgcagttgctgcttgttcaacattatcgacacgtttaacctgttgtattcccatttcttcggccagcttctcaaacttcggcgcggtctcgccgaaagtgatcaccgcttttacaaaagacatatgcggctttagttcatcaaattcatttccgcggtcaagcccccctgccagcaaaatgaccggcttttgaaaggcggacagcgcttttttcgtcgcaagaatgtttgtcgctttgctgtcattgtaaaacagtctgtttttgatcgtcgcgacgtattgcatcctgtgcttaacacctgtaaagctcgtcagcaccttacggacggccgcgtcggaaacgcctgctgttttaacgatgcaaagggcggccaaaatgttctccaaattgtgctctcccggcaaaacgacgtcttccagcggcatgaccggttcgccgttaaacatgattgcgccgtctttcacgcacgctccgcgctcaagtgtccggcggaccgaaaaatacaccttctccgcttttgaacactccgcgagccggacgactgtctcatcgtccaaattgacaacggcaacgtctgtttccgattgatttcgatagacctgctgtttggcaagctcataatttttgcgcgaatggtgataatcgagatgggcatcaaatacgtttaataataatccaatcttcggtctgaattgataagtccccatgagctgaaaactcgacagctctgtcacgatccattcgtctccgctggcctgattggccacttcgcttgccgccgtaccgatattcccagcaacgagcgcttttttcgaatcggccttcagcatttcataaacaagcgttgtcgttgtcgtctttccgtttgaaccggtaatgccgatgaacggagcatctgtcagatgataggcgagttcaacctccgtccagaccgggataccccgcttcagcgcttcttcgaccatcacgttttcatagcggatgcccggatttttaatcagaatgtcgatcgaatgaagatcaaacagttccgtcggatgagagccgcagacgacttccacccctttttccgcgagaatccgcgcaggttcattttcctcaaaaggcagctggtcattcacgacaacctttacgcctttctcatgaaggatcgaagcggcagcatatccgcttttcgccagccccagtacgagcacattttgattttgcaataaatcttgagtatccacttataaccacacctcgatgtaaattcctaagacggcaagcagaagccccgctgtccaaaaagtgacgacaactctccactcagaccatccgacaagctcgtagtgatggtgaagagggctcattttgaaaattcgtttgccggtcgttttaaatgaaatgacctgcaaaatgacggacagcgtttcaatgacgaatacaccgccgatgataacaagcaggatttccagtttcgttaaaatcgcgatcgtcacaatcgcgccgccgagggcaagcgaccctgtatctcccataaagactttcgcggggtgcgcgttaaacacaagaaatcctaacaccgctccgacaacggcaaccgcgaaaattgcgacatcgtattgcgactggttccacgccaaaatcgcaaacgcaccgaacgcgatggcagctgtacccgacaacagaccgtcaagcccgtcagtcaggttgacggcatttgaaccgccgacaagcataaagatgacgagcactggataaatccagccgaagtcaaacgacagctctgttcccggaatgcggatgtcagtcggcattccttggaagtggtagacggcatagaatacgagagcaatcacgatctgaccgatcagtttttgtttggatgtgagtccaaggttgcgcttcatcacgactttaatataatcatccagaaagccgagcagaccgtatccaaccgtaacaaacaagaggaggatcatgttcatgctgacttcggaaaatttcatcgtcataacaatggtcgtcgcgataatcgacaatatgatcatgacgccgcccatcgtcggcgttcccgattttttctgatgggatttcggaccttcctcacggatgctctgcccgaatttcagccttcttaaaaacggaatgaaaatcggagataaaagaacgctgattaaaaagcccatgataatggtaaataaaattacttgttcgagcatcgttcttctctcctttccgcatgatataagaagcagcatacgcatttatcatattcactgttttttttcatatgttgatttatttcatccatcatttcaacaactctttcctgtagttctttttcgattatttcagctcaagaatggctcttttggccacctcagcgtcatcaaaatcaagggtttgaccgccgatctgctggtaagtttcatggcctttgcctgcaatcaggacgacatcgccttttttggcgtttgcaattgcaaaaaagatcgcttgctcgcggttgacgatgctgtgatagtaagctccttttacgccttcctccatatcgtttaaaatggcgagcgggttttcgcttctcgggttatcggctgtaaagacgggttcatcagcaaggtcaacggcgatcttcgccattttcggacgcttcgtcttatcgcggtctccaccgcagccgacgacgacaaacagctttccttccgttaagcctctgcacgtattcaagacattttcgaggctgtcaggggtatgggcataatcgacgatcaccgggaagtcctggcctgcgtccacaagctcaaatcttcctctgacccctttcagcccttcaattccttctgtaatcgtggcaaacgggatatccgctgcaatcgcgatcgcggcagccgttaaaacattgtagacgttaaacaggccgacaagcggaatcgtcacttgtgcagaaccttttggcgtcaccaggtcaaaggttgtccctttcggagccattttgatattttcagccatgacatcggcatcgttttgaattccgtatgtcaaaagatgtgctgacgtcacttgggcgaaataggctgaagcagggtcatccgcattcagcacggcccacttcggtgtttcgtggttaaaggatccgccgagctgcgagaaaagcagacttttcgcatgtttatattcttccattgtctcgtggtagtcgaggtggtcctgggtcaggtttgtaaatgcggcgatatcgtaatcacacccgtgcacccggcccatgtggagagcgtgtgaagatacttccatgacggctgtatccacaccctgatcaaccatttttctaaacgttttttgaagtgtgacgctttccggcgtcgtatttttcgcctcgaacgtttcgtcgtggattttcgtgtacatcgtgccgatcagtcctgtacggctcccggcttttctaaagatctcctccaccatgtgagaagtcgatgtcttgccgttcgtgcctgtaattccgatcagcctcagctgctttgtcggctggccgtaaaaagcgtccgacagcacggcaagcgctctcttcgtatgacggatgataatcaccggcacatcggcgtccacttccctttccgccacaatggcggcggcccctttttcagcggcttggcgggcgtagtcatgcccgtcgactgtatagccttttatacaaacaaaaagactccctgtcttgacttccctggagtccatctcaattgaagttatatcagggtcttcttggccggcataggaaggtgcattttttaaatatgtaagaagctttgtcaatttcatcgtatcaaacctctcaagtctcatcattcttcattcgttgtcatattgattcgccgcacgagcttcgtgcagacatacagttcatattttagcgtaaaaaagaggatacatccagctaatcctttaaaatcgatatattttttaggaggaacggccccggacatcagcaggcagccgctcctatattgaaacgaattaatcagaggctccgtcatcgctgtcaagataaatgcgaatcgtcgatccttcttttactttttcgcccggcttaggggactgctgaacgacgacatcgccttctccggaagccttcagcctgaggttgatcagcaatggttcaagctctgtcacggaaagccctataaggttcgggacctcgatcagctttttgtccagccattgatattcgcgttcgatctgatctttccgcttcttaacgccgagctgcggaagactgtctctcatgatgtttccgacgatcggcgctgcaaccgtacccccgaattgaatcgttcctttcgggttgtcgacggcgacgtagacgacaatgctcggatcatctgaaggagccgttccgataaatgagacgatgtggttgtttttcaaatatttcccgtcttttactttttgtgccgtaccggttttgccgccgacccggtagccgtcgacaaaagcgttccgccccgtcccctgggcgacaacgctctccagcgcgtagcggatctgtttggatgtctcttcagaaatcacttttcttttggcgatcggcgtctgttttttcactgtttgttttgtcacgggatcaatccactctttggcaatatacggcgtatacagcgttccgccgttaacagccgcagaaacggccgtgacctgctggatcggcgtcaccgataccccctgcccgaaagctgttgtcgcctgctctacagggccgacgcggtcaagagggaataggatgcctgttccttcgccttgcagatcgatcccggttttttgtccgaagccgaaacttttaatgtaggtgaacagtttttctttgccgagccgctgaccaagctcaacaaatcccgggttgcacgaattttggacgacttcaagaaacgattgtgcgccgtgtccgccgcgcttccagcacttcagcctcgcgccgtccacttcaacggaacctttatcatagaattgatctttttggaggttgactttgttttcctccaaagctgcggcaagcgtgatgattttaaaagtagaacccggctcatatgtgctccatacaggcaggttccggttatagactttgggatcgattgattggtagtttgcgggatcaaagtccggccggctgaccatcgccaatatctccccgtttttcggattcatcgcaacaccgaccataccgtccggattatacttcgcttctgcgatatcaaattcccgctccatgatcgtctgcacctttgaatcgatcgtcagcttcatatcaagcccgtctttcggcggggtatagtcatccgcctccccaggcattctcttgccttttgcatcggaataaaatttcacatagcccttttcgcccttcagctctttgtcataaaaggcttcaaggccgagcagaccctggttgtcaatgcccgcaaatccgagcacatgggacagatagctgccgaacggataatggcggatcgagtcttctgcgatgtatacgcctttcaaattgagatctctgacttcttttgctttctcgtgggaaatcttccggccctcgggattgatcctttcaatcgacgtttttttcgtgacatgtttatacgctttttcttccgacatattcaaaacgctggccagcagtctgctcgttttgatcggattttcaacttgcttcggaacaaccaaaaccgatggcgcgctttggtttgttgccagcttgacgccgttcctgtccaatatttcgcccctttccggctcaaaaggaaggttccggctccaagaatcttttgctaaagtcgtcagtttatccccgagaacgaactgaacgtatccgagccttgtatcaataatcaaaaagatgatcacaccaaaaagcagaacgaatattaaacgttttctgaccgttacattggaaacgcgcaagagaccgttcactccttatttaggcttgtttcattttatgcctcggagcgttttgatagaacggcccgatttttcatctattcaaggcggccgcgtccaaacggaaggctatcgactttgagccgatagcctttgacgggatctattcgtttttcaatctgactttcacgactgaatttgcttttaattctttgcctgcttttacattttgactcttcacatagccctggccgctcgtttcgatatgaatgcctgccatggcgccgaagcggagggcgtcccgttttgaccagcctgtcatatctgggagtgtgattttcccgtcggttttcaggaagacccgttggttcggcaggacggcttcgcccgctttcgggtactgttctttcacagccaagccatcgccgatcgtaacgggaacaaggctgctgccttgcgcctcttttgcggcggattcggctcgtttgccggagaaatcaggcattttcagctgtttttcttcctgcttttcttctttttcagtctctttcggtgtgatatttaagtagtgaagactgtttttcatcaccggattgaaaatttttgacaccggagcagagcctgtttccgtagcttttaattgcggctgctgcacggccacataaacgagaagctgcggatcgtccttcggggccatgcccatgaaggagaacacgtagttttcgcggccggtcaaatatctgccgtcttctccggcaatttgcgccgtaccggtttttccggcgacatcaaatccttcgatcttgtacggctgccccgttcctttttcagatgtgacgacttttcccaacagctcgcgcacttcttttgccgttttggcagagatcggctggccgacttgttccggtttattttgataaatcgttttgtttttgtcagaatcaacgacatgatcgatcacataaggcttcatcatttttccgttattggcgatcgccgtcgcggcctgaagctgctggattggcgtgacagcagagctctgtccaaaagccgtcgacactttatcccgcaaatattcaaagttgattttgctgttcgcttccccaggcaggtcaatccccgttttgtcgtaaaaatggaatttccgcaaatattgattgaaccggtccgtgccgagtttatcgttggcaaggatcgcaaacgcgacgtttgaggagcgttcaacaccttcattaaaagtgatcgggccccagccgtttccaccgttatggtctttgatcggcttatcttttttagaaaccgaatatgatccagacttgtattgttctcctccattatatacgccttcttggatggccgccgccaatgtgaaaatcttcatcgtcgagcccggctcaaagctgtaggagacaaggtcgttgtaatagttcgtgacatcgcgcacgttcgggttgaagctcggcctttgccccatcgcaagcactttgcccgttttcggatcaacaaccgccgccataatctttttcggcttgtactctttttgaacggtcgtcatgctgtcttccaaaaacgcctggattttttgatcgatcgtcaaatacacgttgtctccgttgtttggcgctttaatcttttcattgctgttcggcaggcgccagcccgttctgtcggtatcgtacgtcatgtatccgtccgtttctttcaaataatcgttcagcgttttttcaaggcccatcatgccttgcatttcacccgttttttcgttgatctgcgaatagccgatgaggttggaggcgaagattccgtttggatagtagcgcttcgtatcgcgggtgaacacgatgcccggcagcttcagcttttcgattttctctttttgggcgtatgtcaaatcccgtcccgccgatccgaattcgacctgaaacgctccttttttatttagaatatcgagcactttcccctcatccatgccgaggatcggcgcgagcttctcagctgtcagctgcttgtccttaacgtattgaggcttcatcttttcgctcataatcgcgacaagcttatatgtcgtagcatcttcggcaagcacttttccgttccggtcaaggatcgatccccggtgggcttcgatcgtccgctttttctcatactgttcgttcgccttctgcgcaagcacttcgccgttcacttttcccgtcgcttgaataaacgcaaaccgtcctacgatgacaaagaaaaagagggcaaaacaaatgctgagtattgccgctcctctgttcatgaatttattttttttcggcattttgcatcattcctgtatgtctttcacttttttatcacccaatttaaggccttttttccgggcgatgtccatgatacggtccggctctttcagcatatcggcttctttttcgaggtcatcaactctgctgctttccgtttcaaccttcttttcgagcttttgaatttcaatattggtctgatacgcggcaaaagcctttgaaatcataaaaagtgaagcgctgagcacagccagggcgaaaagcacaatcaataccttttcccccagcgtaatcgatgctcttctccggatgataacggattgttctgcactgtctgtctgtctttgctgtttttctactttataagccaaattgctcatagactgatgacctccttttaattcgtacagctcactctcgtgctttttccgcgatgcgcagcttcgctgagcgcgcacggttattgtgttcaagctcctcttcggaagctgtgatcggctttctgttgactaattttaatttcggttcaaactccttggggatcacgggcagtccgtgaggcagttcaggaggcgacgacatgtctttaaatgtcgatttgcagatccggtcttccagcgagtggaatgtgatgaccgatactcttccgcccggcttcagcacctcaatcgcctgcaaaagcgcttcttcaaataccctcaactcatcgtttaccgcaattcgaatcgcctggaagatccgtttagccggatgcccgccgcttcttcttgccggtgcgggaatcgcctctttgatgatatcgacaagctggcctgttgtttcaataggcgattgttctcttgctttttcgattttcctggcaatttgcttgctgaacttctcttctccgtatttaaagaagattttcacgagatcctcataaggccattcattgacgacttcctttgccgaaaggcccgccgactggtccattcgcatatcaagaggtgcatcatgatgatagctgaagcccctttcgggtgtatccagctgaggagatgagacgcctaaatcaaataaaacaccgtccactttcgtgatgccgatttcgtttagacggtcttttaaataccgaaaattgctttttatgaaaacgacttgtccttcataatccgccagtttttccttcgcatggcggagtgcggtttcatcctggtcaaaagcgaccaatttgcctttttcagacagctgtgaaagcaaatactcgctgtgaccggcaccgcctaatgtgcagtctacatatgtaccgtcttcttttacatttaaaccatcaactgtttcttttaataatactgttgtatgctcaaacatttctttactagtcccacctttttcaaatgaactgattgcagaagcgccgcatgcgcaaagattcattatatatcaaatccgatcatgttttcagctatttcggcaaatgaatcttcctgctcttctacgtattgttcccaaatctctttgctccacaattcaattcgatttgaaactccgatgaccacgcattccttctcaagctttgcataatttaacagcggtgatgcaatgttgatccggccctgcttgtccaattcgcattcggtggctccggagaaaaaaaagcgggtaaaagcgcgtgcatctttcttcgtaagaggaagggccttcagtttttcttcgatgagtttccattcggacatcgggtagccaaacaggcactgatcaagcccgcgcgtcagaacgaactgctcgccgaggccttctctgaatttcgccggaacgatcatgcggccttttgaatcaatcgtatgctggtattcacccataaacatgatctcggtccccactttcgttcctcaactcaccactatccaccacttctctccacaaatttattttacactgttttagaacaaaaaaaaaccctgaactactcagggttttttaaaaaattatttcaaagtttgacaacttgatgcatgttttgaaatgaatatggcaaatccttgtatttttccaagaaatccggaccgtatttgttcaaataatacacgatgttccaaattctctcctggggagcgtctaaaggtttgatgcttgtttgaattttgtcaaaatcacgcaaaatatagttttctttttcttcaatccttctgatgactgttttctccaaaaattggagctgatcttgaatgaagcccgcgtttttttctaaaagggggccgaggctgccgtcgatttcgagggcttcggcgcgcactgcggaatgaatgttttcgattttttctttcgcctgtttgaccgaatcggtaaatccgttcggaaccttatcttgaaaatactgctcttttttggcccgcgctcccttttcaatcgattcgcggagttcgattccccgttcgtccagctttttttcgatgtgccgttcaaggaatgtaacctgaagcctcggtacgacaggcggcattttatagcccatgacctgaaaagcgcctttcagctcgccccaataattgatctctccgggaccggcgatgaacgccaatgtcggtagaagatattcctgcatgagcggccgggttacgacattattgctgaacgcttccgggttctggcagatcaaatcgcaaagctctgcttcagaccactgaagatgaagctcttttataaaaaacgcgccgttttctttttcaattaaaaaccgctcgccgtcgcgctcataaaaaatgttcgcatgttgtgcggccccttcgataatcggtgtgtaacccagttgtttcatcaattcctgctgccgtttgacagagtcggtcagctcatcgtttttgtccagcagctgccggaaaaagcgcgcttcaaggtttctgatgcccgggtctccggaattcaaaaggatcaagccgtcttgttcaaacatgtcggcaacaagaaattcgaaaaaatcggtgaaagaaagagactgccttaaacatcggcgcaaatggccgagaagatcattcgtatactccgtttcttcaaatgaagcaaaaatcccgtccagccacttttcagctttctcggcatcgagcgccgtttttgccgcctggctttttttccagtgggactgcgggagcttgtgctttttcaccttgccgccgtcagaaatgtagacgtgattgatttcttccagatcatggtcttcccccgcaacccagaataccggaatgaccggaacgttcagctcttgttctttttgctttgctaataaaaggatcgatacgattttatgtatagtgtaaagaggacccgttaaaaggccggcctgctgccctccgacaacgacgacgcttttcggatcgcgaaggcgttcgattgtttcattcatggttgccgattgaaatttgcggtgatagtcgagcaaatagtctgctaacgcatcgcggtcatacgtccgggaggaaaggtcatccaaacggacactccaactttcattgctcaggccgtaatcaaaaaacggctctatctccttttttccatttatatagtctcgtacaaaagggttttgactttgtatggaaagttcagtaagctgcatctctagaacttcctttctccagtaaatagttagctatccgaaacgagtatagcacgttatgcgattcggtcaaaagatttagcttcattcgttttcaagcgccttgatgctgcgatataaaaaggtaaggtgcggggcgggctctcctgactcttttgcccgcttcagcagatagccgatgatcgcatccgcttccgtttttctttctgccagcacatcggcaagcattgaggacgtgttgcttttcgtccggcggcagacggaaagaacatggtcccacgctgcctggcgatcttcaagttccaaaatccggctcgcttcttcaaagacgaacttcatataggccccatacatcggctcctcaagcagcgcgccgtttttcacccgcaaaagagccgtcagcggattgatgcaagcattgacaatcaatttttcggcgaggggcttataccagtcttcggaccaaataaaagggaacgcttcatgcaccgaagcgagctcttttttcagccgggcggcggattggcttcggaacgcgctccattttacggccccttttcccgtgtgccggaatgtgcggtcatccaccctgacagctccgtgttccacagatcccgtatagatgcggtggcccgtctgccatttttcaagcacgggaatatgcgccattccattttgcaggaacatgatgtcaagaggagccgcctgctccagctcagacagaacggctccgagctgatgctcctttacggcaacaaaaagaaggtcgcagtccggatcaagttcagtcacgcccctggcgttcacggtcatctctttcccgtcttcaagaaggcggattcccttttcttcaatcgcttccgcctgttcctttctccgcgcaatcacagtcacttcgtggccgaacgaaaaatagtatgcaaaaaggaggccgaccgagcctcctccgatgactccgattttcacattctcacaccctgattttttcatatactgtatatcatagcagaaattttcgccgttgacttgtcagttgtttcaaatattcagaaccgtttcgcttcattatattagaaaatttttatcatttggattttttgaaaaaagcgtttacaatagaagtagaccacaaacaagggggtaacataatggtcaaagtcgaacgtttgctgatcaactacaaaacgcttgaagaatttaaaaagttcagggagtacgggattcaagagctttccatgctggaggaccttgaaagcaacatgattgaaaacgacagcaactcaccgttttacggcatctattacggaaatcggctcgtcgcaagaatgagcctgtataaagtggatggtaaatcaaaccaatattttgaagaaggccaagattacctcgagctctggaagcttgaagttttgccggggtatcagcgaaacggctacggaacgatgcttgtggagttcgccaaatctttcggactcccgattcgcacaagtccgcgcgtcaaatcatccgatttttggaacaagatgggctttacaccggttaaatacgatatggcccgggataaaggggaaaatccgctcgtttggcatcctgcgagcgaacctagtcaaagttctgaatcagcataaacgaaaaaagccggccgatagcggatggccggttttctattttcaagcttcccccagattttcattcggctccggctggagcatcgcctttttgtttcgttcgtctccctgaagaacgaccatttttctggctctctccatgatttcaatcagcgctttataatcctcttctgtcaattcaagcttttttttcagcgattgattttcgcttcgcagcttttcaacttcttgtttcagctcattgatttcttcagcaagctttttcttctcgtcgataaagtccttttgaaccggggcttctttcagcttttccaagtactctatgacatcatcgagcgtcaggttttccgccttgctctcagaaaccgttttgacagatccaggaaggtttgcggaatggatgccgatttttttgcgcagctctttgcgctgcttctttgccagttcaatgcctgattggtattgctttctgacaaatgaattccagcggaatccgcaggcggccgcggttctgcttaaagccttgcccacttcttcaaaggctgaaagctgtgtcccgccttcccgaatgtgccttaatacgacctcagccagcaatatatcttcatcctgtgtccatgcatcctgtcttgtaatcgtcaaatgttatccccctccatgactttatgaatttacctcatacatatgcggctgatagagtagatagactattttctttacaggaaataaaaggatgaagggaaaacgggtataaaaaaacacaagacatgaagtcttgtgttttcattgttgacgattagttgctttttacgtcttttcctttgtatgatccacatgctttgcagacgcggtgtgaaagtttcatctcaccgcagtttgggcattctaccataccaggcacttgcaatttaaagtgtgtacgacgaagtctttttttcgttttagaagttcttctaaaaggtacagccattattcccacctccttaaagagcgttaagattcatcttcttgttttaagagcttcccgagtccggcaagtctcggatcgatccggtctttccggtcatcttctgtaatgacctgccaatccttgccctcctgcggagcaccttcttctttttgaacagactcacaaaagatttgcatagggatctcaagaaggatttcttctttcacgaccggagtcaagtcgatgaggtcatcttcaacaatatggatgtcttcatcttccatttcctcggtcttatgaaatataaacagttcttttgtagaaatgctgaatggataacgaacatcaacaagcgttcttgagcaaggcaagatcatctcgcctgaaatggtaaaatcaaatgcagcctgctttgagcggatttctgcgcgccctttcacccgcaccggtgaaatgctgcggatttccgagctttgagagagttcgcttaaatcaactgtttcatcaaattcaaagtccttcttcggcatttgattcagctgatgtatcgtccatttcattgtatcacctctaagtgagcaacaaacatgattatagctttcatcatgttttttgtcaatattttttctttacagatatgcgcctgcgcctttcattcgttgacatcgtgaacaacaattcatacacttaggaaaaacgctgttttcgcgaggcgtctggacattccatgtgtaaatgtatcataactatttcaagagatgcaagagaggtgaaaaaatgaaagcggtcggccttgttgtggaatacaatccttttcataacggacatttatatcatataaaggaagcaaaatcagaaacgcggagcgaggtggcggttgccgttatgagcggctcctttttgcagcgcggcgaacccgccatcgtatcaaagtgggcgcgtacgaagatggcgctcgcatcttttgccgatgtcgtcgttgaactcccttacatattcgccgtccaaaaagcggaaacgtttgctgaaggcgccgtctcgattttaaatgaattagggtgttcttctttgtttttcggaagcgagcacggcgatattgaggcatttctcaatacagccgcacacacgatagagcacgaagacaggctcaacgaagaagccagaaagcagatagcgtttgggctgagctacccgcaagcgatggcaaaagcgttccggtctgtaacaagagaaggcggtaacatcgttgacctttcaaagccgaacaacattctcggattccattatgtgaaagccatcatgcaaaagcaattaagcatgaagcccgaaaccgtcaagcgccggtcctcaggctatcacgattcaacattccctgaagcggaccgaatcgcaagcgctacgagcatacgcaagtcgatttttgaaacgggaagccttgcggacagccgcttctaccttccaaagacaacggtcgatgagctcgatgaatacgcccggactttcggcatgtggcactcgcccgaagattatttcccctttttgaaatacagcctgcatacaatggatacagaagagctgaaagggatttatgaagtggaagaaggacttgagcaccgcgccaaaaaagcgatccgaaaagcaggctcatttaaggaatacatggagcttttgaaaacgaagcgctatacgtggacaagactgcagcgcatgaacacccatatcctcacaaaaacgaagaaagccgacgttaagcgcatgttaaacgaaacacatccggcatatatcagacttctcggaatgacaaaaaaagggcaggcctatttggctgaaaagaaaaaaagcttgagcgcaccccttattacaaagacgggatcgttttcccatccttccctccagcttgacataaaagcgggccaagtatacagcgccccgctcaaagagccggtgcggacgatgctgacagagcaggaatattccctttcgccgatcaggtatgacgaagacagccggatatttttgcgcaaataaaaacacctgatggacatcaggtgtttttcactttatcttccaaataatgaatcgcatcatccatcgtgtcgacagggacgattttcatatcggttttaatatcttttgccgtttttacagcttcttcatagtttgatcctttttttccgccttcgttcggggcaaaaaagatgtcggctcccgccttgtctgccgcaacgactttctggctgatgccgccgatcggaccgactttgccttcgtcgtcgatcgttccggttccagcaatatggtgtcctttcgtctcgtcttcttttgtcagctggttatagatctccattgacatcatcagccctgccgaagggccgccgatgttttcaatatccatatcgacctccggcttcaccttgacattgcggtctgtgatgagggagacgccgagccccgctctctttggatcttctttgaatgttttcagcttcatctcatatgttttttcttctttatcccgttcaactacgattttcacgcggtccccggctttttttgactcgatgtagcggacgaagctctccgctgaccggaacgattttccgtccgcttttttaattttgtccccgacttgtattttcccttctgcaggcatgccgctgacgaccgacatggcatatacgccgttaaacgtgtagctgacttcttttccggcccgcttataagcggcgatcatcgcattttcctgggaatctctcatcatttgcagttggcgcttcatatattcctgatcagattcgccttcttgtttaaaattttcttccggaagaatttcgtggtaagggcgcatttttgcccatatatatgtaagcgggttggcaggaccgactttaactgtcattaaagaaaagctccctttttcaggatagccgttatcgactttaattaaagggttcagctcggtcgcttcgccaggttcggtgatgtaatatggcagcttcacaaatgacagcgcggccacgatgataacgagcaatagtgcgatgcgtataattctttttttcagcatgaaaatgtaaccctccatctttattttcaccggctcacatcttgatccggcttcgaattttcagcctgcatgaattcacagatgtatgaaatgccttcttttgatgctcatcaaggagaagggtttccgcgcgtttaaagagcttccggttcatttgtttcatcgccgatctgcaatctggtggtctaaaataaggaccagccttcgtataatgataaagaagtttcacggagaaggctaccgcacaaatcgggcaagcttttcgtttattttatcatgatcctgtttccaatgtgtattcacagccgcaaagggggttagaaatggacatgtcaaaggtaaagacactcatgattgccgttttgctgctttcatttacagctgccgtcattacccacccgcaagaatcatttgacgcttctaaaagtggacttgccatgtggtgggaggtcgtattcccttcccttttgcctttttttattttatcagagctcttgatcgggtttggtgtcgtcaggtttgtcgggctgttgctcgagcctttcatgagaccggtgttccgcgtacccggcgtcggagggttcgtgctcgcaatgggaatggcatcgggaaacccggccggcgcaaaactgacttcaaggctgagacaggaacggcagatttcccgggtcgaagcagagcggctcgcttcattcaccaactcatctaacccgctgtttattttcggagccgttgcggtcggctttttccataatccttctcttggcgttgtgcttgcggcggcccattatttgggcaatttcgcagttggactgacgatgcgcacttacggaagaaaagaagaaaaccgcaccgccgtgcgaaagaagcttcctgtgccttcaattaaagaagccttaaaagcgctccatcaggcaagacttgaagaaaagcggccgctcggcaaacttttgagcgatgctgtcatctcctccgttcaaacgctgctaatggtgggcggcttcatcattcttttttcggtttttaataacattctttctgtgatgcacatcaccgacattctttcgcacgcgacaagaatgattttgacggctcttcaattgcccggtgattttgataagcctttattatcgggattgtttgagattacgctcggcagcaaactggtcagcgcaacggatgcggcgcttctccagcaagcggtgatcgtcagctttattttgggtttcagcggcttctgcgtccaagcgcaggttgcaggcattcttgctgaaacggatatccgctttaagccgttttttatcgctcgcatcctccagggaatttatgcagcgatctttgttcttattctttggaagcctctttacacatcgttctattctccgactgagccggtcttctcctttctgacggccgggaagacggaacctttctttctggagatgtggaacactttagcagagatcggtccgctcctaacaatcggcacccttctcatctatatcattctttatgccaaatcttacgcccctgttaaaaaatgagcagccggttacggccgctcattttttgcaaactttttttcaagtgcagcctcgaccgcttccggcacgagttctgcgactgaacctttatattttgccacttctttgacaatgcttgaactgaggaacgagtattggttattcgtcatcataaaaaacgtttcaatattttcatcgagcactttgttcatcgaggttccctgcatctcgtattcaaagtcagataccgctctaagcccccgcaggatgacgtttgcctgcttgctctttgcataatcaatcaaaagcccctgaaaagattccacttgcacattcgggatatcctgcgtcacttcgcgaagcagcccacagcgttcttccactgtaaacagcggcttcttcgaagaattgttcaaaacgcatacataaactttatcaaacactttcgccccgcgcctgatgatatccaaatgtccaaaagtcaccggatcaaaacttccgggacaaacggcaatgctagccatccccattccctctctttctgtatatggtcacgcctgttaagccgtatatttcctgccgggcaagctgaagtccgcccgccgcatccggcagcatgacttccttcgcatgctcagccacaataaaccctctttcagtcagcatatccgcttcatcaatgatcgataaaagcgcttccagcttttgctctcgatatggcgggtccaaaaagacggcatcaaagcttgcgccccttttcaccagtgcatgcagagcccgttctgcgtcatttctgtacacttcggcgcacttttctaagcccagcgttttcaaatttcctttcacggtttgaatcgctttaaaatcccggtcgacaaaaatgaagcggtcaaatccccgcgacagcgcttcaatgcccaatccgccgcttcccgcgtacagatcaaggccggtgccgccttcaaaatacgggccgaccatattaaagatggattcctttactttatcggtcgtcggccttgtcgacgtgccgggaaccgcctttaaggcacgtcccttatacgtcccagaaatcactctcatacttccaccactttttcttaaaactcgaaaaaaatcattcctatcttatcataaagtgttttctggcacaaacacccaaagtgcaaattcatatgtatagcaaaaaggctcggtggtgataataatagcaacagcatcgattgatgttgttgccaaccgcggagaagacttacgtttccccataagttcttcctccggtttctcctctccctttgccttctccttaattttttaaggaatagaaggaccccgcagaggtatttctgcggggatttttttaacataaaccaagttagagcccggctttatagtcgtattctttcgctttatcctgcttggattcaaactccattttcaaaaacggtttgtatgaaagatccacctgtttgacaaaagagtacgaacgtatttttgcgatgattctttcggcatcttccatattgcaatacaccactacatatttcagccgctttgaaacgtaatgaacatttccgaatttcctgagcattttcgcctgcttcaaggagtgcagccaaacgattaagccttgacgcctgatttccaaattgttcacctgcctgtcgctctgtgcatgaagttctataaaaaaacgaggctcggggcgaccgagcctcatcaggaaactttacagccgcagcttccgcctgacccgcagccgccgccgcaagatgaaagattatcaaaataagggtttccagtcggtactttgatatgttttgacacagcatgaccgatttccacgctgacttcatcaagaatggattgcagctctgtttccgcctttttaaattcggctactgtatcgtgaaggtcaagctcccgtttgatttccctcattttcttggatatctctttataatcaggatgatacttgccaaagcgctgcacatcctcgtactgttcttttattttcgtaaacgaagcgataatacgtccggcctcttcatcttcgcggagacgcttgtagcattttctgtaatgttcagccgcctctgattgaagaatcatgttggccaaatcatatgcttcattttgaagccgcaacgattccattgtggcaaacatagacatgcacctccagctatagtgtatcacaaaacagccgttttcaaaaatgtctatgccgcctccgaactataattttccaaaaacttcgctttcacaagcggaatcgcgccaatcagataagcctttgggctttggtttatgggtggcgcagccggccagcaagaggcacagaaagattacaagccagcacttcttcatcacagatcaactccttcacacctagctttaccagaatggcgcgatttatcatcataaaaaaagactcaggctttaaattaatcctgagtgcgcatcgcatgaaacatttgcagcatcatctgggccatctgaatgctgcccgataactggttgaccctgtgaggaatcgttttttcataaaaattcatcatatcgagatgaaaggctgacagatcattcggattccgcgaaagcttgcggtaccagaccggctgctcacggatgaaccggcggcgctcttcgtcggcgaacacatactcctgcacttctttacgcatgtctttctccttccctaatcttttcggaaagaaaacggatgctcgccgccgctttgtttctgctgtttttggcttccgcccgaaaactggctgagcaagctttgcagcgaagaaatagactggctcattttattgatctgctcattcatttgattggcatccatctttcgaacggccgtcaccattttcgaaatgaaatcgtttttgccgccagcgtccggctccttttccgctgaagcttcttccctgtacggatcccatatcgaatcgtcttccccgagcaaaacccagttttcatagacttcctgccagcttttttcttgtttccggacttcggaaatcaacttaggatgccgttttataaattgcttaaattcattgatggatgattgcgcgttttgatttgccaacgtctacaccccctccgaaaacatatgcctactatagtgtaatccgccccggcaaaaaatgttcgcctaaaattcctctttttacaggaacggtgagcagccgacatttcaggatttctcaaaaaacgaaaagcccgggtattgtcccgggctctattgccattctttaataaagttttgcgtataatatttctcatccaccccgacgccgagatgggtatagtcggcatttaagagcgcttttctgtgcccttcgctgtttaaccagccttcaaccgccgcaggcccgtcgacatagttgagcgcgatattttcccccgcctgctcaaaattgacttttcctttttcaagcctgtctttgagggtgccttccgtttctgacacatgggagaagtaatggtgctctttcatgtcgctgctgtggccgtaagccacttttgatacgccttcatcccaagtgagctcagacaggccgtgccttgcgcggataacgtttgttatatcaaaaatctgcttctcatttgctttctcgattttcttccaatccgattctgtcaatgctttaggctcgatcagggtgcctctgtagacaacttcatacggcctttgcttgattaaagtcggcgcatcaaatgccctgatgcttgaaagcgtcccctcgaatttatccatgtacagctgaacatagatgtctccgactttaaccgtcggccttgtattcatatcttcctcggaaaactcaaaacggtatgaactgcctttatattgaacattgacatacggggcgatctgggtcgttttgaaaacttcccttgacggccgtccgattttaaacggagcggtgttcaccccgtcgcctgtcgcaaacaatgtcacagccttgccgcccagcaagccgatttgaacgtactgttttttcccttggttatagacccaccattcataatcatacgctgaaggatcgactctgtccggtttccccagtttcttttcgatcgtctcggccgattccccgataaaggaaagcaggccggaatcgggaatgttcaagggcttctctttttttgcatcttcgtttgagacttgcggcttgtcttccttcgcaattttctcaggcgttgagccgtattgaataaacagcgtgtatgaagccgcaacgatgagaaggatcacgaccgctcttaatatatttttcaaactttcacctccgactgacggatcaatctatccattaagctgcgcacgcatcaaaaacttgcctttagtgtcatttaaacagaactgacatgaattttcaatgttaatacagcctattaagatgtgagacaaaatatgttttaatgaagaaaatctccaggccgctcttcgttttcagatataaatgtcagcgcgtcgccagcctggcggttcgatttattgtgagttgaaacatcgccgagcgtaatgatgccggcaagcgtttttccccgtgtaaccgggacccttctgatctgataatctcccatgagatcgaccgctttttcaattgaatcgtcttcacttaccgtaatgagatcagtcgtcatgacatttgtaattttttgcgaattcggttttttagctgcgattccccgcagcactaaatcccggtcagtgacgatcccaaccagttccaagccgtcatcaagcacaaccggaatcgctcccacatccccgtctttcattttcacggcagcctcgtatacattatcaagaaccgtacaatataatgtttcctttgtcatgatatctttcacacgtgtcaatcagaagacctcctcttgtcgttcgtttgttcatattgtcgtcaagccgcgcgcgattcatactgtccacaaaaatatttatatatcggctcaggcaggattgaaagtttaacgctttcatactatgattgtcagtaaaggtaatttttttaagggggttttacgggatgaaatttgaagaatccggaattgaaggattgactgccgaccttaaccggttagacgacatcatggaaaacgaagggttcgtaagagctggacaatgggattatgaacgcgtcacatatgaccgcaaattcgatatggtcgaaggaagattctaccttcgcgtgttcggatatgccatcgaaggtgacgtgggcgcccggcgcgcggtaatcaaactgatgacgccgcttttgggcaaatattattatccgcatggagtggaatacggcgaagacgaacattttccgccgcagctcctcaaaacaagcaagacggtgctgaattcgatcaaagaaaaggtttcagcgcttgaagtgtagcaggcgtacataaaaaagggtgcagcccctcggtgaggctgtacccttttttgaccttaatgaaccgtagacggagaatatgattcttcttccaggtccttttcgtctttggctctttccttcctcgcccagccgaaaaagataatcgccaaaaatgtcccgtacacgatttcctgtaggattttcatgacaatcgcgccaagctgctgatcttcgagaacaggcatgctgctgaacatttccggacctgtaagcgtcattccgctcagcgtatcgagaggaacgcacagcttcattgcctccgcccatgctgacggatccgaatatgtcgaatacagagccgtatcgctgaacatgattaacgcgcacgccggtgtcagcaaaatgccgtcagccataatgtagccgagtttcaaaagtccgctcatctgcggaagctcctcgaccttgtgaacgagcggccaccacatgaaaaacgctgcaataaagatcagcacggtaatggcggcatgataaacggcatccgtctttataaaatcaaacaccaatggaatgtgatacatcgaaaatagaccgttaaacacgattatcgcgatcaatggtttggaaaaaaaccggaacagcggcttgacgatcggcagaaaaatgacctttttccaaaaccaaggcggtatgccaaggatgatcagaggcggcacgatcaaatacagaaccgccatttgcgccatatgcgcgctgaacataatatgtcccagcaaatcaaccggactgcccttagacgcgtataaaagaatcatcgccgtcaggaataaaccgatttctttcctggacgcccgctctccttctgatcctaagcgtttcatcagaaaaaagtaaagggcggttatgaaaacgacagcccctaggaaataggggctccaaagggcgcgaaaaccgaatatttcaaggctgcccaacatgagcatcctcctttctgtatgtcggttcgattaccaccagattagcgttacaaaagccaacacggtaacaaaagcgaccaaaacgcccgaataaaggaacaaagtcggcgcttcatgcccccgctgactcatatgcataaagtaatacagctgaaacgcaacctgaatgacggcgagcagcagaataaacggcaccgtaaaccatacgccggcatctgaggcgaccgttaaaaaagcgacaatggtcaggccgatcatcaaaccgaatgaaataacctgatatctcatgtcctccgcgtttttctttttgcggtaggcaagatctgttttgggattccctctgttttcgttattcaccatttttatcccaccatccccatcaagtatacaacggtaaagataaacacccagacaacgtcgataaaatgccagtagaggcttgcgacaaaaaacttcggcgcgttgtaaaggcttaatccgcggcccgcatttctgatcatcaaagaaagaatccagagaagcccgaaggtaacgtgtgctccgtgtgtgccgacaagcgtataaaaagcggagccgagagccgagctttgaatggtgaacccatattcgtgaatgtaatgcgtgaactcatatatttcaagcgccagaaagcctgcaccgagcagaacggtgattccgagccaaacctgcatctttttaaaagcgaagtttttcatatgatacatcgcatacacgctcgtcaaactgctcgtcaaaaggagcattgtcgcaagaaagaccagccccatgtcgaacatctcggtcgttttcggcccccctgcattcgaattcttcagcgcaaggtatgttgcgaagagagacgcgaaaagaaccgtctctcccccgagaaatagccaaaagccgataaatttattttttccttctaacgtagctttttcaggagaagccgggaaggtttcagccgtcaatttctcttctgtatgcattatgccttcacccctttgtcgtcatcatccatcagatcttctttatgaatatggtacccgtggtcatcaattacagaccggagaagcatcataaataacgtgatccctaacccgatcagaatgacaggcagcccccaggcaaattccgtccggtacataaagccgaaggcggatataaacagcccgagtgacatgatgaacggaagaatcgatccgtttggcatatggatgtcctgaagcggctccgcggcggtcattgactgcttgccggctcttttttcgatccataaagcatcaaggcctctgaccaaaggcagctgtttgaagttgtattcaggaggcggcgaagaaacggcccactcaagcgttcttccgtcttgccaaggatcgctgccgactttttcccctttggcagtcgtcacgataatattgatcacgagtatgatgaccgcagccgccataaacacagctccgattgaactgatcaggttcgccatgtcaaatccctgattcggcaagtatgtgaacacgcgtctcggcattccccacaatccgagccaatgctggatgaagaacgtcaggtggaacccgatgaaaaagagtacaaacgttattttgcccaacgcttcgctcagcattttcccgaacattttcggccaccagtaatgagctccggcgaggatggcgaacaccactccgccaatgatgacgtaatggaagtgggccacgacaaagtacgtgtcatggaactgatagtcagccggtgcggcagcaagcatgacgcctgtcaccccgcccataacaaacgtcgggataaaggatatcgcgtaaagcatcggcgttgtaaacttgatgctcccgccccacgccgtgagcagccagttgaagattttaataccagtcgggacggcaatggccatcgtcgccaccgcaaaaatggcgtttgccacaggcccgagtcccgttgtaaacatatggtgagcccaaaccatgaagcctaaaaagccgatcaatacggttgcaaataccattgaagaatagccgaacagcctttttctcgcaaaaaccggaatgatttccgaaaaaatgccgaacgccgggagtacgagaatataaacttcagggtgtccgaaaatccagaacagatgctcccaaatgatcgtatttccgcctaattccggattgaaaaagctcgttccgaacaaccggtccagcatcaagagcgcaatgcctacggtcagcggcggaaacgcgaacaaaatcaaagccgaagcgacgaatgtcgtccatgtgaaaagcggcagcctcatgtatgtcatgcccggcgccctcatgttgatgatcgtcgcgagaaagttaatcccggcaatcagcgtaccgatcccggcaatttgcagaccgagaacatagaaatcgatcccgtgcccttcggaatgaagggaaagcgacgcataagacgtccagccggcatcgggtgcccctcccaaaaaccagcttaaattcagaaagatgccgccgaaaagaaacagccagaagccgagcgagttcaagaatggaaacgcgacatcccgcgcgcctatctgcagcggaacgacggcgttcatcaatgcgaacaacagcggcatcgccgccaggaaaatcatcgttgtgccgtgcatcgtcatgatttcattgtagaccccgccgctcatgatgtcattgttcggtatcatcagctgaaccctgatcagcatcgcttcgattccgccgagcacaaagaagaacccgccgcccagcaaataaaggatggcgatctttttatgatcgacagtcgttaaatagtcccataatacagccccaaaaccttgctttttcttaagcgtactcacaatgtaacctccctcattctccctttgaagcgttagtcttcggtttttaacccctttaaatattcagtcagtgcatcaagttccttgtcgctcaaatcagggtatgtgccggtcattttgttgcccggttttatgctttcaggatccttgagccacgctttcaagttttcatcgttgaattccttcacgccggcgatcgtcgacctgtctccaaaagtcgcgaggttcggagccgttctggccgcttccgccctttggtcttttgaatcggtcgcatgacagctcaggcagtttttctctttgaacaccttttctccttcaacagcgagatcggttttcgcttccgctttattgttttccatatcgctcatccatttcttgaactcatccttcgaaaccgctttaactttaaagtccattaaagcgtgggaaggtccgcagagctcggcgcatttcccgtagaaatagtctccggctttttccgcccgttttgaatcaatcgttaagtagaacttgttttcattgtctgtgttcgtatcaaccttgcccccgacagaaggaatccagaatgaatgtttgacatcggaagctttcagcttgaagtaaatgcgttcatcggtcggcacgaccagctcctggctcgtaatcacgccgtagtcaggatattcgaattcccaccagtaaaggttcgcccgcacgttgacgacgagcgtcttctccggatccctgtttttcttatccatcggtttcgtatcagcaagatcaaaggtctgtgcgacaacaggaacaaccaggataagaaggaggataatcggaataacagtccataaaatttctaaattgcggtttccttcaacctgtttcgggatgtggtcatcaccgagcttagatcttctgtacttgacgatgacaaatacgaaaatgaaacttaccactactacaacaacaaccatgatcagcgtgctgagaatcattaggaaatactgctgatcagccacctcgcccgccggctgcagcgttgatataaacggttctccgcaccctgctaaaacaagcgccaaaatagtgaacagcgacatcagacgccatttctttaacatttcttcccaaccccttttcaatcaatccttttgaaactttcactgttcaaacgtttataggacacctattcattcatctgactccccactccaattaaagcacttacatttcctcatttcataaataatgaggttttttactcaaaataccatctatgtatgaacgtaaagccgccttgttaaacataatcgaaaaaatcgataaggcggcttttacatgattgttgtctgcttgaagtgttaattgacagccttcaatgtgatgaattatagagttctatccaattttaaaaagtgtaaatacgaccatggcaacgaagaaaatggtcaagtaatttaatgaatatacaaacatgagcgttgcccacttcatgatatttttgcttctgtaaccgaccagaccgcaaacgagccagccgatattaagcaccgtccccaaaatgacgatcggcagtccgagtccgcccaggaaaaacggcagcggcattaagcaggcaatccaaatgatgatctgccttttcgtcacttcaaaaccgtgtacaacaggcagcatcggtatatttgcggctctgtattcctccgttttcttaatcgcaagcgccagaaagtggggaatctgccaaataaacataattaaaaacagcacccacgcctcgactccgatggaaccttggacagcggtccatccgatcaaaggtggaacagcccctgacacacttccgatgatcgtattaacggtatagcggcgctttgaccacatcgtgtatagaaacacgtacgtaaagacgccgacaaatcctactgcggcagctgtcagattggtcatcagcagcatgataaaaccgagcgcagtcagcagaatgccgaaccacaatgcctgtgaaggctggatttttccagtcaccgtcggccttgttctcgtccgctgcatgagctggtcaatatcacggtcataaaagttgttgatgacgcatgagcctgcaataataagcgaggaccccgctaaagtgaacagcacgatatcaaggtttcctagaaagctcagatttgaaaagtaaaaagcgagccacatgcccgtaaaagttgttatcaggttcgagtaaacaatcccgactttgataagggcgaggaaatttttccatgctgtcgtctcttctatttgtccattcattgctgtatcagctgtaattcttgtttcagccataatactaaccccccttactcaaaccttcatcacgtcaagagaagcggtatattcataaaaaacctacaactctatcatacaagattaccggatggaaaaaaacagcctattaaatattaatcgacaaaccggtttatatttgtgaactttttatgactttctttacagatgaaggaaaagttgtgaacaagagcggaaaaccactgtcattctaatatagttctatcaaacgaagccacaattatcaagtcttcaaaaccaataaaaatgtgaacgccttctattgcatttttgtgaacaataatcattatgaattgcagcagaacatcaattcgcttacacttgaaggtggtaaatatctttttattagtcagtttgcattaaaaaggagaattgaatttatgaataaagcattaaaaggcttgggaattatcacaactatcgccatgcttttcgtgctgatcggcggcgccctcgtcacaaagacgggttcaggaatgggctgcggcagatcttggccgctttgcaacggaagcatattcccggctttaacccttgaatcgattatcgaatggagccacaggtttgtcagcggcacatccggcgtccttgtgctggctctcgccatttggacatggaaaaaaatcggccatatcagagaaacgaaatttctcgcggtgatgtcggtcgtctttctcattcttcaggcgcttttgggcgctgcagcggtcgtcttcgggtcatcggccctgatcatggctttgcacttcggaatctcgcttatttcctttgcttctgtgctgcttttgacgctcctggtgtttgaagctgacagcaaacagaaatccgaatcgttttatataggaaaaaccatgcagtttcatatgataggaatcattatatacacatatgtcgtcgtttatacaggcgcatatgtccggcatacgagttcaagcctcgcgtgccttgactttccgatgtgcagcacggaaaacggctggcttcccgggaagtttcacgaatgggtgcagatgggacacagagctgcggcgcttcttctgttcgcctggatcatcgcggcagcggtacatgcagcaagacagtataaaaatcaaaaacgcatttattggggctggatgatttccctgatcctgatcatccttcaggctgcctcaggaattgcggttgtctacagcagactggatttgggttttgcactcgcccacgcattctttatttcctgcctgttcggaatcctttgctacttcctgctgcttgttgcgcgctatcgcaggcaggtgcaaaaataaaaataaacggttgatcctccgccttttgcgggggattttttcataaaaagaggccgccgacaaaagtcagcggccgcgcttttattttttcagttcaatgagaaggtcgccggtttgaatggcttctccgtttgtaacgtgaatgttttcaacagttcctgaaaacggagcctgaacggtcgtttccattttcatcgcttcattgatcatcaaatgatcgcccttcttcacttggtcccctttgcttacaagaagcttgattaccgttcccggcatagatgccgcgatatgattcgggtttgaacggtcggctttcaccttttgatgaacggacgatttaatgctttcgtctttaatgaccacttcgcgaggctggccgttcagttcaaaataaacgactctcgtcgcatccggacgcggttccccgatagagacaagtttgacgatcagcgttttccctctttcaatctcgacctcgatttcttcgccgagggtcatgccgtagaggaaggttggtgtatcaagcacagagatatccccgtacagttccgctgtcttgacatactcggtaaacactttcggataaagcgcatatgcaacagcatcctggtcggaaagctccataccatgcttttccaagaattccgcttttatagcgtcaaatgaaaccggttcaagcagttctccagggcgtactgtaatcggctcctgcccttttaaaatcagcttttgcaatttctcagggaatccgccgtgaggctgaccgatataccctttaaaaagctcgacaaccgagtcaggaaaatcgagagattctcccctttcgtaaatatcatcttccgtcaggttattttgcaccatgtaaagcgccatatccccgacgactttagatgacggcgtaacctttacgatgtccccgaacaggtggttgacccggctgtacatttctttcacttcattccagcggtcgccgaggccgactcccttagcctgctgctgaaggttgctgtattggccgccaggcatttcatgcttgtaaatttcggtatgaggcgcaatcatgccgctctcaaactcgctgtaatattttctgacagactcccaatattgagacaacgactctaccgcatcgacattgaactgcggacggcgtttatctccttcaagcgcatggtaaagcgagcttgcgcttggctgtgatgtcagacccgccatcgagctgaccgctacgtcgacgatgtcgacgcctgcttctatcgccttcgcatacataaaaataccgttgccgctcgtgtcgtgtgtatgcaagtggatcggaatgtcgatcgtttctttcaaagccgacaccagttcgtatgccgcttgaggtctcagcaggccggccatatctttaatgccgagaatatgcgcccccgcagcttcaagctcttttgccattgacgtataatattcaagattatacttgcttctgttcggatcgagaatgtcccctgtatagcagatcgccgcttcggcaagcttgcctgactcgcgcactgcatcaatggcgagcgtcatccctttaacccagttcaagctgtcaaaaatgcggaatacatcgattccggccgcagccgattcgctgacgaactttttaatcaggttgtcagggtagtttgtatacccgacggcattcgaagatctcaaaagcatttgaaacatcgtattcggaatttccttccgcagctcctcgagccttttccacggatcttctttcaagaaacggtaagcgacatcaaatgtggcgccgccccacatttcaagactgaaaagctctggccagagcgcagccgtcggattggcgatttttttcaggtcatgcgttctgactcttgtcgcaagcaatgactgatgggcgtcgcggaacgtcgtatcagtgaggagcacttcctcttgatctttcacccatttgacgagcccttcggctccgcgttcatcaagaatctgttttgttccgcttgcgattggctgatcgacatctgttttgacgatctgcggcttatcaaactcgggcttcttctttttatcgatgcccgggaagccgttgaccgttacgttcccgatatatgtcagcattttcgttccgcggtctctctgcttaggaaagacaaaaagttctggcgttgtatcgataaaagacgtgtcgtattgccctgtaagaaacttttcgtgtttcgccacattttcaaggaaaggaatgttcgttttgattcccctgatcctgaattcctgaaggttgcggaccattttggctgccgcctgttcaaacgtcagcgcccaagttgaaagcttaacaagcagcgaatcgtaataaggcgtaatgacagcgccctgaaaactgtttccggtatcaagcctcaccccgaaaccgccgcctgagcgatatgccatgattttgcctgtgtcaggcatgaaattgtttgacggatcttcagtcgtaacccttgactggatcgcatatccgtgcagcgtgatcgcatcctggttcggaatgctgatttcgctgctgtccagactgagaccggcagcgatcaggatttgcgtctgaacgatatcgacgcccgttaccatttccgtaatggtatgctccacctgaacacgcgggttcacttcaataaagaaaaactcatcgttcgcaactaaaaattcgactgtaccggcattgacatattcaacattcttcgcaagcttaacggcagcatcgcaaatcttttcccggagggattcagaaagcgaaacgctcggcgccacttcgatgaccttttgatgacgcctttgcacagagcagtcgcggtcgtaaaggtgaaccacgttcccttctttatctccgatgacttgaacttcaatgtgcttcggcttttcaatcagcttttcgacataaacttcatcattgccaaaggccgctttcgcctctgatttcgccctattataggactcctccagctccgattcgtccctgacgatccgcatgccgcgcccgccgccgccaagcgacgctttaatgataaacggatatccgaacttttccgcaaattgtttcacttccgctatatccgccactggtccgtcgctccccggtatgaccggaattccagctttttcagcttgttcgcgggcttttactttgtctccaaacatatcgaggtgctcggaggtcggtccgataaagatgatgccttcctcttcacaccgcttagcaaactgaatgttttccgacaggaagccgtagcctggatggatggcatccacatggttgcgttttgcaatctcgatgatgccttcaatatcaagataagcgtcaatcggctttttcccttcgccgaccaggtatgcttcatcggctttgtatctgtggtaagatccgctgtcttctttagaatagatcgctaccgtacggatattcagttctgtgcaggcccgaaatacgcggatagcgatttcccctctgtttgcaacaagaactttttgaatagactgttgtgacatgtcgttccccctcatccgctgttataagtatgtatctattctaaatgaatcggatggtcattgtacacgcttagttttttaaaaatttatactttttttatattgattttctttcgcttttgtagtattgacaggctgttttcgtttgaaccgatcaaaatattcattaaacatgctgatgttcaccaatatccccgcgcttgccatcagcagaatgagcgatgaccctccgtagctgataaacggaagcgtcacccctgtcaaaggaatcaagccggatatgccgcccaggttcacgaaagactggatggcgatcatgctcgatatgccgatcgcgagcaggcttccaaacggatcatcgcatttcctcgctatataaaacccttttaaaacgatgaaagaaagcagcagcacgacaaaaaggacaccgaaaataccgagctcctcggcgatgatcgccataataaaatcggtgtgcgtttcaggcagatacccatacttctggacgctctcgccgaggcccaggccgaacagtcccccggaaccgatcgccaagtaggagttgacgacttgaaagcccgaatctcccgcatctttaaacgggttttgatagctttcaaaccgcttcatccgtccttctgttaaaatgctgtcccagttgaaataaatgagcgggctgacgagcacaaggacaatcccggccaaaagcacgagctttaacagcgttttgccgctgaatcccgagcacaaaatgatgcacaatgcgattaaagcgatgataaaggccgttcccacatccggctgagcagcgaccaaggcgcaaatgaagagcgtgatgatcgcaggaggggcgattccggctcccaagttgtcaatatagctttgctttttggcgtagacggaagaaagatacaagatgacggtcagcttgacaaactcccccggctggatgccgtaattcgaaaccctgaaccagctttgggcattcccggccacatgtccgacaacaaacagcccgaacaaagcgacgacggaaatgagcagcaaaaacttttggaatttttgattggcaaaagccttatacggaaaaagcgccgcgcataaaaatatgacggttccgagcgccaaaaacatcagctgcctgtcaaaaaagtagctgctgttttgtccgtaccttgtcacggccgtgatcatgcttgaactgtacaccatgacgagcccgaacccgcacagcaggaatacagcgaagattaatgaataatcataggatttgagcattctttttatcatattatcctcttccttacttgccttcaaaatgtgtttgtggtagttccttcgttattttactacactttcttaaaaagcacgaaagatacccttttcataagacttcgaatctcctcagaaagaaaagtccgtctgttccaagactgccattctatttttttatcggcaaatcatgcgtcttcgtttattcggcgtgaacagcggccattccttcatcaactggcgttttctttctcattccataataaaaaaagcctgccggcagtttgtttctatcgaaacgtcgtcgacaagctgactcagacagaaagattcttctgaggtgttcatttatttttttgtaaatgcatcatgtaatgcagacaattcacgctccagcctgtaaagcagttctttaccctcttcttcatccactaatccaaggcggacagcaaaatcaatttctctagagagtccgaacatttgtgtatctaaaacctcttcataaagaggacattgaggcatcgttaagttgtccatttgcacttgaatcagctttaagattttatcagcatcacgttttaacagagcaagtgctttttcacgatggtcgactacaatctcagacgccaaaagtatccctccgttccccaggcgagtacctaattcttctatttatgataaagcctcagccgaaaaaaagcaagctatttctgtcctttcgccgtatttcaaagactcgctttttaagcttccgctaacgttttaaaaaatgcttaagctgtaattcgcagataatagctctaaaagccggattccggcaatgctgtttcccttttcatcgagcgaaggcccgaagatgccgatgccgaaacggtatggggatagccccatgatgccccctgaaaccccgcttttggcgggaattccgattttgattgcgaattcgccgctggcattatacattccgcatgtcaccataaatgtcttgcaaattctcgcgatatccttcggtatgatttgttctcccgtttcgggatgcttgccgttcaaagcaaaaacagagccgatttttgccaggtccaggctgttcatttcaatggcgcactgttttgtataaacatccataacatcctcaacctcagcctgaaaaatgccgtgctctttcatgtaatagcacatcgccctgttgaccatcgaggtttcaaattcagattcggcgaccttcccgcaaacggtaatgctccggttgtttgcaagttttttaataaaatcaagcagtctcccgatcttatcagcgttcgtctctcctttaatcatgcttgtgaccaccaatgctcctgcgtttatcatcggattcagcggcttccccgggttgacggtttcaagcttgatgatggagttaaacggatcgccagtcggctcttgtcctacgtaatgaaacactttttccggtccgtgatcgatcagaacgagggcaagcgacaatacttttgatatgctttgcagagtgaatgctttttccacatcccccgctgatatacaagtcccgtcggtaaagtagaccgccgccgataaatcgtcctccgataattcggccaaagccggtatgtaagatgcaacctttcctttgtccgtcacttttttcgcttctgtgacaaaatattcgagctcctcattatgccggcaattcaagttttttccctccatccgagcgtcattgctgttatctttcccggagagggcttttgttatgagaagtgacaattcgaaagaaagcgcttataattttttgtgagggagtggtagagacatgagcattgtaacgatcacaggaaatgtaaagtatccgattacgctcgatccgagcgtctggatttttgatgaccgaaaattcgatctcgagcagttcttttcacatttcggagaggtacaggatgaagatgacgaccttgtgattgaccgggaacggcaaatcagagaaggtgctgtatcgccgccgacgctgaaatcagagaaaaagtatgaaaaggaaaaattgcttgacggcactttcggaatcaagcttgagccttttttgaaaaacgcggaggtgtcaggctccgccgtcaaatgcctcttcaaaacggaaggtgaagacgtttccgttccaattgaagaagcgggcggcatgattctctgcttcagcaacaaaggcaagccgcttggcgaagacgggcctgtacacgtttattttcccgacggttctaacaagatgaatcctgtgaaacgagtaaaagaaattcacattatttaaagcggcaacactgtaacgggtgcgccggaggcggggaaaaaactccgcctcttcttttcccggccgggttttcggcttttgcagacgacccggccggcgtgccatgcaagttgaaacccgggttaaaagcccggtttttttatttacagcaggtctgctgcaagccttgcaagccgggagcgctctccttttaaaagcttcacgtttccggaaattttttgatctttaaagcgctctactacataggccaggccgttgttcatcgcatccaaataaggatgatcgatctgttcggtatctcccatcaatacgattttgctgccttccccgacgcgtgtcagaagcgttttgacttcatgcttggtcagattttgggcctcatcaatgatgatgaattggtcgggaatgcttctgccccttatataagtaagggcttcgacttgaatggagcccatccccgccaaaatatcatcaagttcccccggtttttttgcattgaacaagtattccaggttatcaaaaataggctggacccacggtcgaagtttttcttctttttcacccggaagatagccgagatcttttccgacaggaacgatcggccttgtgacaacaagttttttaaaattccccagatcctctgtctgcagcaatccggctgccagcgcaagcagtgtttttcctgtgccggcttttccgatcagggtgacaagcggaatatcttgtcttaatagaagttccaacgccatcgtctgctgtacgtttcgggaacggatgccccaaacctgctcctggtcaaaaacaagctttttaacggcttttccgctttgatctacgattccaaccgcagaagatgatccgccgagcgcgtccttcatgacgacaaactggttcggacacagcggctcctcgctgatttcgtcaagctgcaaataatgatgttcaaaaaatgaattcatctgatccgagcgaatgtacacgtccgtataaccgctgtatatatcatcattgtcgacaaccctgtcgtgcaaaaaatcctctgacatcaacccgatggcatcggctttgacgcggatcagcatatctttgctgacaagaataaccggtctgccgccttctttcgtttcttcttcaaggctgaggtttttcgctacggctaaaatccggttgtcgctagttttttcgataaagatttcctgaagctgctgaaaagagcgatggttaagctcgattctcaagcttcctccgttagggagaggaacattttcatacagctttccttttaaacgcaaatcatctatcaatttagatacgcgccttgcattcctcccaatttcatccatgtaacgtttctttgaatcgacttcctccaatacgacagccgggatgacgacctcgttatcttcaaaagaaaagattgaattcggatcctgcaataacacattcgtatctagcacataaattttactcaatcttccgcctcctgatcaggatttttagccttttattttcatttgggttaaaagctgatggagcgcccgctaaaatatatgtttttgtgaataaagatagaaggttaattcaacaataaaaattaatgaaagcatttttaaggaggcaacctcaagtgcgaatcttttttttgatcctaattcaaaccgttatgctgctttcagcctgcggcattcaaaataatgcccgaaatgaagcaaatgagcttcccggcaacagaccgattcatgtaaaaaacagcgcccaggagccggtgaaccgcgaagacggacaagccatctcacggcgccttgtaaagatcaccgaaagcgttccgggtgtcaatgatgcgaccgccgtcgtgctaggcaggctctccgtcgtcggaattgatgtgaaagacaatttggaacgcagcaaagtcgaatccattaagtattcggtcgctgaagctctgcagaatgacccttatggagcaaacgccgccgttgtcgcggatcccgacactgtaaaccgcctgcgggcaatgggcagagaaattcaagcgggacgtcctgtcaaagggattctcgatgagctggcagccattgtcgggcgcgtccttcctgaagtgccgaacgacgcaacagacaaccagcaaacaaatcctacaaaatccaacaacgaccagctgaatgagagaaaccaaaaacaactcgaaaagaagcagaataatcaatcgaacaaacatatgaaaaatcggcagcaataactttaaaaaagcctgtgccactgttttcttgacggtacaggctttttccttttttctaatagagaaaatttatttgtcagatcgattaaggtataatggatcgtaagcgaggtgaatcaagtgagggtaaagtgttcattgtgtgacaaaatcgaaaaaatcgatgacgacacactcattgccaaacgtctccgaaaccggccgatacatacctatatgtgccatgaatgcagcgaaagaattaaaatcaaaaccgaaaaccggatgaaaaccggccgttttaagttatatccgcacagaaaagataaagagcagatcaagtcataaaagcatggacaagctccatgctttttttatctctttttgttacataagtaacaaaataacagaatatagttgataaaattttcatttgtagtattttaaaattgtttcatatgcaacaaaaaaggagtgattgatcatggattttgatgtattgattgcaggcggcggccccgtcggtctgctgacggcttccgagctggctttggccggcgtccggacctgtattgtcgaacggctgaatgagccttctccattctcaaaagcgctcacactgcatcctcgctcaatcgaaatacttgaaatgagggggcttggagaacgatttaaggaaattggcaagccgctcggttcggggcactttgcaggtctgaagactggattggatttttctgcgcttgacacgcgagccaattttacactgttcatcccccagtacgaaactgagaaggtgcttgaggaacacgcgaggaatctcggtgtctgcatccttcgcggtcatgaagttctcgctgtccgcgagcatgaagacaccgccgagcttgtcgtccagggtccggacggcctgtccttactaaccgcttcctatatcgtcggtgccgacggggccggaagtaccatccgcaagcaggcgcgcatcgctttttccggaactgatgcgaatatcaccgcaatgcttggtgatgtgtcgcttgaaaatccgccggaatcgcatttctatacttgcgtgaaccgtgaaggcggcgttgtgatcgtgcctttagacggcggcattttccgcgtcctcataacggcgccgcatatgccccaagctttgcttcacgagcccgtcacactggaagaattaaaaaaagaactcagccgcatttgcggtacggactttggaattaacagcccggtttggatgtcccgcttcggaaatgccagcaagttggcggagcattaccgttccggcagaatttttttagctggagatgccgcgcatatacattttcccgcaggtggacaaggtttaaatgtcgggcttcaagatgcgatgaaccttggctggaagctcgcagcaaagatcaacggacggtgtcccggctggctgcttgacagttaccatcatgaaagacaccctgtcggcaaagcgctgatcgtcaatacacaaatccaaacaaagctgtttgattttacgcgtgaagggctgtacctccgtgaattgctatccggcatactcggattttcagacgtcaatcgctatctggcagaacaaattgcagcgctcagcgtgcagtatgatgcagatgaaaaaatgcctgaacatgagctgaacggtaaacgcctgcccgatattgacctgaccctttcagatggtactgtcaaacgactttacacatttcaccgcgatggacgtttcttattagcagcattcggaaaagaaccgaaggaattttccagactgcctcatgtccggcttatgcaactgaaagcgattgacggacggcctgaatggaatggcgtaaaagcagcgctgatccgccccgacggccacatagcctgggctgtggacgaatccctggaaaacgcggagcaattgattgccgatggaatccgccgctggtgcggaaacgcttaatctgcaatctgtttaaccattttgtttcacgcgtaacaaaatggtataatcaaagcagaataatcgattaaaggagccggttttctgcatggaacatttaacacacgccaaacaagaaatatttgacctgtacatcaggctcattcatcagcaggagcagcaagaaaccgtcatgaaagagcgcatctccgcagaaatgaaaaagatggagcgcgaattcggagctgaaatgagactcaatatgtctgacatccatacgatcagctgcattggcgaccacgaaccgatcaacgtcacctcgatttccgagaagatggaattttcaaaagcgacggtctcaaggatcaccgcaaagctgaccgaaaaagggctcgtcagcaaaacacagctcagcgataataaaaaagaaatctacttccgtttaagccataaagggagaagcatccatcaccttcaccagcgggagcacgataaaatcgaacaaagatttaaacgatttttaagccggtattcatctgatgagatcctttttgccagggctttgtttcgggacttattaacggcggattttctcgcggatacagaaaagacatagccgaagaaggctatgtcttttctacgtattcgcccccgtctgctcttttttcgaacggtgcaggcggattttataaatcgaaaggattaaaacagctacgatcagcccttctccaaccggcagaaaaacgccgaaaaaagttaaaaacgtacagcctaatgccagaaaaaagtaaatgatcgccgttttcaacagcggcagccgtttggcgaaacccagtttaaagacgaccgcagacaggacgaagatggtggcataaagccaccacattcccgcctcgggattctggtccactttatagagagcggcaaaaaacgacagccgttcacttacatcagtcaaaaagattcccctcccctttgcttagttgggttgctctttttttaggttctgcaaatattacgacaatcctgccagctttttctttttcgctgctttttcgcgttcgtttttgtcgagaattttctttctcaatctgatggattcaggtgtgacttcgcagtactcatcctcgttcaagtattcaagcgattcttcaagcgacatgatacgcggttttttcatgctgaccgtctgatctttcgtcgctgagcgcacgtttgtctgctgcttcattttgttgatgttgacgacaaggtcgttttcacggttgtgctcgccgacgatcatgccttcatatacttctgtgcccggctcgacaaaaatcacgccgcgctcttcaacgccttgaatgccgtaggctgaagctttcccggtatccattgagacaagcacgccttggcggcgcccgccgacttgccccggctcaaccggctgatagctgtcaaacgtatgatttaaaatcccgaaaccgcgtgtaagggaaaggaattcggttgagtagccgattaatccgcgtgaagggacattgaaaatcaggcggacttgcccgtttccgttattgatcatgtcgatcatttcacctttgcgcgcacccattgattccattacagatccggtatgctcttcaggcacatcgatttgtacgcgttcaacaggctcacagcgaacgccgtcgatttctttaatgatgacttccggcttcgatacttgcagttcaaagccttcgcggcgcatgttttcgattaaaatcgacaaatgcagctcaccgcgtcctgacacgatccatgcgtcaggagatggcgtcggatcgactcgaaggctgacatctgtctgcagctgctgttcaagccgctcttcaatcttcctggccgtgacatattttccttcgcgaccggcaaaaggactgttgttaaccgcaaacgtcatttgaagcgtcggttcgtcaatgcgaagaaccggaagcgcctcttgatgctcaatcgggcagacggtttctccgacattgatgtcttccattcctgatacagcgacaaggtcgccggctttcgcttcttcaatctcgactctcttcaagccctggaaaccgaagattttcgtgacgcggaacggcttgacagaaccgtcaagcttcattaaagcaacttgctgtccgaccttcatcgttcctctgaacacgcgtccgattccgatacggccgacataatcattgtagtcaagcagagccacctggaactgcaaaggctcctcatggttatcgacaggacaaggaatatggttgacaatcgcttcgaataaagcctccatgttttcatcctgctgcttcggatctgctgacgcggtgccgttgatcgcagaagcgtaaacaaccgggaattcaagctgttcttcatttgcatctagctcgataaacaaatcgagcacttcgtcaacgacctcttcaggacgggcaaaatcgcggtcgatcttattgacaacaacgatcggcgtcaagttttgctcaagtgcttttttcagcacaaagcgggtttgcggcatgcagccttcataagcgtcgacaacaagcagaacgccgtcgaccattttcatgatccgttcaacttccccgccgaaatctgcgtgtcccggagtatccaaaatattaatgcgtgtatctttataattaatcgccgtatttttcgctaaaatcgtaatgccgcgctctctttccaaatcattggaatccatggcgcgctcagccacgttttcatttgcacggaatgtaccggcctgatggaggagctgatccaccagcgtcgtttttccatggtcaacgtgggcgataatagcgatattgcgaagatcttctcgaagtttcacattttcatctcctaaaaaaattcagataatctttcatattataactgacaaacaaagttatttcaatttgtttcaaattttcagctcccattgcccctttctatccagcgcgattttctgtaaactaacagtagacttcatactaaggggatggaaaaacagtgaaacaaatcaaatggattttcttattattcgcacttgctgcagtgatcagcatcatgatgatcggagttgcagtcgccgaaaaaagcgcagccggcgtcgcaatcgccatcgcgattctgatcgtcattatgggaagcggttttacactgaaaaaaagaatgcgcgaaaaaggcctgcttgaataggaaagaagcccctaccgaatgaaggggcttttgattttatatcaaaaaaccggcggctggttgccgccagttcttataaaaagaataagtaaatcaaaagcatcagcaagtagcccccgccaaacagcgctgcccctttgagaatcagcctttgataatacgctttcctgaacttttgttcttccgcttcttctgcttcctttggcaatcctccgtcatcatgaaaattgacaggttccctcatcatgtcgtacatttcccggcaatcctcgcatgtcttaatgtgtgcggcaaccaaacgttccgttttgcggctgcaatcgccttctatgtataaaggcagtaaatctcttacaagatggcatttcatattgttaaacctccctgccttccaagctttttttcagctccaggcgggcccggtgaagattggtttttacctttgacagtttccaattcagcacttccgctatttcctcgtatgacagctcttgaaactctcttaaaatgaggacagtctggtaatcttctttcagccggtcaatgtgatgtttcagctcttcctgcattatggcgtttgccaaatggcgctcaggcatttcaaatgtgtgctgttccatatcgccgcaggccgccacgtcggaaaattggatttttttatcttttctgtaccagttgataaacgtatgatgtgcgatcgtatacagccatgttttgatcgaggaatggcccctgaaagactccaggcccgcaaaagcttttagaaacgtatcctgcgccaggtctttcgccgtctcaagctgatgggttcgcctgtacaaatagtacatgatgtcatgataatattccctgtacagttcttcaatcgtctgttttttattgtgagccatttagaaaaaaaccacaccgtcatccaaatcgataggagcaggaaagcaccatataacgagtaaacaaaaatcttgatatgaaggagcttctgatgatcatctgttttttgcatgccggggagctctctattcccggctgctgccgcttcagcctgatcctgaaaaaactgctcatgctctttcatccagatcatcgtttcctcttccagttcactttcttgatagagctcatacaaatcgataaacaccgcttttttttcttcatttgtcatcaaaatgtttcacctcatctgtctcggcatcaaccaagtatgcgtcatgttcatttgagccgaacggctggatgatgacaagccacgcataacggctcttttgatccccgtctgaaacgattacaagcttcgtccgtttatgatagaccagccctttttgatagcgttcagacactttctgaaaagctttttccccgtctgcatacgtgtaggggggtttttcatctgctttttgaaagttttttctcaccgtcagataagctccctcttcatgtttcgtcatggtccagaccgtatttaacacagcatcgctttcttttttctgaaattctatcagatccttttctaactccacccttttcagattggaaatgtcttgatcaaataatgaaagcaagcgtttttcaagctcttgtccgcgataaggcaaggcgctttcagatttgatcgaaatagccgttaatgcacctgttacagggtggaactccatccccattccgtcacttgtctttatgttgatggatgccgagttgaggctgaatgggaataataaatcaatatctgtcagccgataagatgagacgggtatgcccagcttacgatagacggcttcaactccccgctcgatatcctcaccagaaacgcgggcttggttcacgctttctaagctgtaaacagacgcgtcctcatggaatcccatcagagtctccttccgccaagtaaaccacattgtgcttaattcaggatcctcgcattcacggtaaaattcaacagtagcttcgccgtcatcacggctgacctttgccttgatttgtttgtcaagttcgcggccgtgttcccttagaaattgcttcgaccgcttgatatatgcctgaccggacaggatattcccgctaggctttttttgattgtgataattggtgatcattcccgtccagccgtcaacgtccgcatcgtaatctttcgttttgaaatgataaacgttatgaaaatcctggttggtagctgacaaatagataaagctctctgtcggaaaaaacgagctgacagtctgcttcgcttctttaaccgaaacaggccgaaaattggcatcaaccacgtctgaaacctccgggtgtgagattgtaaaagcggcatccgccaaattgtaaaaaggattgaggtgaagcgtgaaaaatacggcggtgcccgcggctaaaacacgcttcaccatcaacaaaggctttctcgagtcattcagcaagtgatatgtcataagaaaaccgatcattgtcaatacgttcagcggaaaaaattcgtatccaagctttttgatgaagaaaccgccgatcgtcacaatataaaaaatcaaaaggagaacgtaacggtttcttttccaataaagctgaaaaaacaagcagatcatcagtcccggtattccgacaatcaacaacagaacgagcggcaattcttcaagctcctccgctccaaattccttcaaataggcggcaaagctgaacagcgattggaaaagcggcatcgccatcaccgcaatgtcaaatgcaaaaaacagccccttgccccctttttccgcgagtgtcatcatataatgaaaagagacaagcaaaatatagccgaacagcaaaaactgcataaaaggcagaagcgcatcttgttcgtctatgtacaggtttgaaaactcagcggctttcatttggtgagccaattcaaacgaaagggcgccaaccagtatcagcctgagaacgatgcctgcataaaaaaagaggcgccgcctgcacactttcggatgaaatgacacggcatacaaaaggacaaggcctgtcacacaccactgaatgacaagcatgctctgtctgcttaaaacaaaataacgttcaaaatggagcacataatcactaaatagttcgatcaatttccacaattcctttacatcaaattaaggcctcatctttatagacaaacgacgctgcatattgtttcataaaatcataaaaaaaagagacctgttgttaaacaagtctcattgcagcctcaagggaaggggcaaaaccatgatcaaatatcgttttcccttttcatctttttccgttttcagctgttcaaatcctgaacgggccagcatgttcaaccattcgtctttctcataaggcactgccgcaaacaacgctttatgccccttttctctcaagcgttttccgatcgttttgatcacttcttttgcctggccttttttgcggaaatcgggatggacaagaagcgttccgagccaaggcttgccattagaaggcgcccattcgagatgaaagctgagagccgccggcagtcccccgtcttcccacacgagccattcaccgttatacatcgcataagcactcatatagcgttccaggctgctttcgtcaagctcttccttcacccacccggggctcgcttcggccagctcttcaaaaaaggcgagatcagaagaagagaaagacctgctattcatgcggcaaatattcgtcgaaaatcgcccggtgagctgccggattgccggctacgatgctgtggttttcaagaaaattgagcggtttcccgtcaatggttgtatatgttccgccgacctcgtcaagcagaatgcagccggcagcgtaatcccaaggagcgagcctcatcgtcacatacacatccattctgcctgccgctacataagcgagttccaaagccgctgaaccgtatgaacgggtccctctgacgcgcctgacaagcggggataatacgcttggatcgatccgtctgttctcggtgatccatgtcgcattgatggccagaatcgattcctcaagcggcacttctttcatcttgccgagctttgtattgtttatgtaagcaccctcgccttgaaaagcatgataaagctcatcgtgagttacatcataaatcaagccgattttgccttttccgttttcaaaaatgccgattgaaatcgcaaaattgcgtttttgatgaataaagttcatcgtaccatcgatcggatcgatgatccaaacgacgccgtccaaagatgtgagcttgtccccttggccttcttcgccaagaatatgatgatccggaaaaaccgattgaattttttcaatgaaaaaacgctctgtttccttgtcaatgtttgtgacaaggtcatttggattcgatttcgtttcaatcgtcatcttttctttcattgattgcttaattctctgaccagcttctttcacccagcttttcgccaggcgatcgatttccttccagtttgtcatcacactacctcttttctatgtatacctgttgatttattcatagcatactgatattaaccgggaaaaatcaagaaaaatgacaaatatccaggcagcccagataaaaacgaacctctcaaacggttcgtttttattatggtttcaaccatgtaatctgatccattcttttctgagtcgttccagtttgcgcttgctcaactcgatttgggtttcatcctttttttccatagcttcaaaaagcgttgcaagttcataatcgacctcaagcctccaaacagcggcccgattgtctttttcctctttcaatccttgttttactattggtttcatgtgccctacgccccctccagagaaaattgatttcaaaaggaatccttctggctttaagtcctaagcgtgatatatattaatttcttattcatatcgtatgaagtgctcaaacattcgcaacgttattctaaaaattgtgtgtttacctaacgattccccaaattccgcaaggcgaaacgtaattttttgtttgaaaagccgactgtgatacaatatctttactgattggacaaggaggaacacaatgagcagtctgcgttttactgaagaggattttcgtacatttacaatagaaggtttagatgcgcggatgagcgttctgaaagacacagtgcgcccgaaacttcaagggctcggcgatcattttgcgcctgttctgtccgctttgacaggagacgaaatgtttgtccacgtcgccaagcacgcgcgccgctcagtcaatccgccgaacgacagctgggttgctttcgcaaacaataagcgcggctataaaaagctgccgcatttccaaattggtttatgggaaacccacgttttcgtatggtttgcattgatctatgagtcccctctcaagcaggaatacggccagctgtttaagaagcatctgccggatattgagagcagcattccaagtcgctttttctggtcggccgatcatacgaaaccggatgccaagagacagtctgagatgaatgaaaaagatctggaaaacctgtttgaacggctcgtcaacgtgaagaaagcagaagcgctttgcggtattcagctttctaaagacgaggtgctgcatatgagtgaagaggcgtttctatccgaaatcgaagcggcttttgaaaagctcgccttcctttaccgcctgacgcagaaagtatcggtataattaaaaagggatggccggtggtgccatccctttttgttttggattttctcattacattttaattttcgtatcttccgtttgttcctttgcttttttgactgcttgatacggagagtagtcgctcgcttcttcaaactggctgcacagctttttttcctccgcttttcccggaacgatttctttaaagcggcggtaagcactcatcagcacgtctcgctctacgcctttttcataagcgagctcaaccgcctgaaaaaacgatatgacgtctatcgcttcctctgtgctccagtcttcattcatcggatattggtacccttcttccatttggttcatctccttgtgcagttcagcctgacggcttgtatagctttagtattggttctcttttttgcgactatccatagggacctagaagccccttacaggaaagatgataaaatgttctttacattctttcaagaacataatataattcatttgttttatgccatcaagcaaaaacgcaaaataactcaacgatttttgataaagattagtctttaaggaaatagcaggtttatcatgaaggtgggaaaacaattgttgcagcacgaaacacccctatataccggattaaaaaaacacgccggcaaaaacccgatccagttccatataccggggcacaaaaaaggctctgggatggaccccgaattcagggagtttatcggagaaaatgcattaagcatagatttaatcaacatcgagcctctcgacgatctgcacgcgccgaaaggaataatcaaacaggcgcaggatctggcggctgaagcattcggagccgactacacgttcttttccgtccagggaacgagcggcgccatcatgacgatggtcatggccgtatgcggacccggagacaaaatcatcgtcccgagaaatgttcataaatcggtgatgtcagcgatcgtcttctcaggcgccgtaccgatcttcatccatccggaaatcgacgatgagctggggatttcacacgggatcacccctgaatcagcgaaaaaagcgctgcttgagcatcctgacgcaaaaggactgctcgtcatcaacccgacttatttcggcatagctgcagacttaaaaagcatcgtcgagcttgctcattcttttcatgtcccggtgctagttgacgaggcgcacggcgttcatatccacttccatgaagatctgcctctttcggcaatgcaggccggagcggatatggcggcgacgagcgttcataagctcggaggatcccttacacaaagttcgattctcaatatgaaagaaggtctggtttcaaaggaaagggtgcaatcgattttaagcatgctgacgacgacatcgacctcctatctattgctcgcttcgcttgatgtcgccagaaaacgcttagccacagagggacacgaactgatcgaacaaacgattaagctcgccaacgaaacaagggaacgcatcaatgatatcaacgggatttcatgcgtcgggagggaaatcctcggctccaaagcggcttttgactatgatccgaccaagttgatcatatctgtgaaagacctcggcctgaccggtcatgatgtggaaaaatggctgcgcgagtcatgccaaatcgaagtggagctttctgacttatacaacatcctgtgcatttttacaccgggagaccggaaagaggatgcagatgcgttaattaaaggattaaccgagattgctcaacaggccgcttcatctgcggaaaacagacgcaagcctgaagtgcttctgccaaacattccggcgcttgcgatgacaccgcgtgacgctttttacgcaaacacggagatcattccgttcaaaaaagcagctggcagaatgattgccgagtttgttatggtttatccgccagggataccgatcttcattccgggcgagatcattaccgaggataatatcaactacatcgaaaagaacctggaagctgggctgcctgttcagggaccggaagatgacaccctccatatgatccgcgttattaaagaacagcaggcaatcctgtaaaaacataaaagcatgcggcactgtaaatggccgcatgcttttttctattcttcctctttaagatggcagttgcactgtccgcacgttccgtaaagtatcgtcactttctcatcttcaaaatgctgaatggtttcattgcagtcttgacaaacgatcgtgcccatctttcattccccttttcttttcaaaatggaagcgtttaaatttgttacccctataatattatgtcacattaatattgtcaacggtaaattgtataacacatttaaatcatttttgctctttttctaaaaaaaggccatcatgttatatatgtattcctgcttaaggtataagcagaacgcttcccggctgattccgacgatgtacccatcaaacacgctcaacctacaacatctcataaataaaacggcagttatcaattgtgtaacaaatgggtaacaacgaaaaattatttcaattatcatgataaaataggaattgtttactaatcgaacaggaaaatcggcttgcattatatagagaggtgaagagacgtcatgtggtttcgagcgatattcaccgccgcaatttgtttcctttttttgacgagtggatgttctttatctcacatcatgcctgaccagcagcatcaaagcaccaatcaccgccacctcaagctcatctttttttccgatgacgagcatatggagcaggaagtggcttattatgatgcgcttttggatttaaaaaaagaatttcccgaacaggtttcaagtatggaaatttcacatgataaaggcgagtggaaaaaagaggttaaagtctttccaagcttgctgcttgttaatgataagaaagtactggttaaaattgaaggaaaaataaaagataaagataaaattgtaaggcttcttcaaaaggaattgaaacattaaaagccccctgtgcatgtgcaaggggattttttttctgcttcacatgtatcccgggcaatttgtcatgcacccgaataagagaaaacataaaaaaaccccctgcagagggggtttttgatttattttacaacgtggatcggcatgccgatggcaacttctgcagcttccattgtgatttctcccaatgtagggtgagcgtggattgtcattgcgatatcttcagcagtcattcctgcttcgattgccaagctcagctcagaaatcatgtcagaagcgcttgctccggcgatttgtgcaccgatgactaagccgtcttctttgcgtgttacaagtttaaggaaaccgtcagtttcgtttaatgacagcgcacgtccgtttgctgcaaacgggaatttggctgcagtcactgaaagaccttcttctttagcctgtgcttcagtgtagcctacagatgcaagttcaggctcagagaatacgaccgcaggaattccaagatagtcgatttccgcagcttctccggcaatcgcttcagcagcaattttaccttcataagaagctttatgcgcaagcggaggaccttcgatgatgtcaccgatcgcatagatgttcggaatgtttgtacggcattgtttgtccgttttgatgatgccgcgctccgtcatttcgacgccgacttgttcaagtccgagctcgtccgtgtttgcaacgcggccgacagtgacaagtacgtagtccgcatcgatcgtttgctcttcgcctttcacttcgaacgtaacggttacgccgtcagctttttcttctacgcctttagccattgcttttgtatggatttcaacgttgccttttttcttcaggttgcgtttcacaagagagctcatttgcttctcaaatcctggaaggatttcttctccgccttcaagaatgacaacttcagtaccgaagtttgcatatgcagtaccgagctctgttccgatgtagccgccgccgatgacaacgagcttcttaggaatttctttcagtgcaagtgcgcctgttgaattcagtacgcggtcgctatatttgaagtttggcaattcgatagggcgagaacctgttgcaatgatcgcatttttgaacgtgtaagtctgagctgagttctcatccatcacgcgaacagaattgctgtctacaaagtatgcttcgccttttacgatgtcgactttgtttcctttcagaaggccttcaacaccgccggtaagcttattaacgacagaggctttccattcttgaacctttgtaaagtcaacttttacgttttcagcagtgatccccatctcttcagaatgcttcgcattctcatagcggtggcctgcattgataagcgcttttgaagggatacatccgacattcagacatacgcctccaagattgcctttttcgacgattgttactttttgtccaagctgagcagcgcggatggcagctacatagccgccaggtcccgcaccaatgacaagagtatctgtttcaatagggaaatctcctactaccattacattacgcctccattaaaattaattgtggatcgttcagcaaacgcttgatgtgattcaacgcgttttgtgcagttgcgccgtcgatcatacggtggtcaaagcttagagaaagagccagaacaggtgcagcgacgatttcgccgtcacgaacgacagctttctcagcgatgcggccgattccaaggatcgcaacttccggatggttgataaccggtgtgaaccattgaccgccggcagagccgatattcgtaattgtgcaagaagcgcctttcatttcagcaggagcaagtttgccttcgcgtgcttttgtcgcaagctcgttgatttcgtttgaaatctcaaaaatcgctttgcggtccgcatttttaacaaccggcacaagcaggcctttttcagtgtctgccgcaataccgatgttgtagtagtgcttctgaatcacttcatctgtattgtcgtcaattgatgtattcaggactggatattttttcagagctgatgtcaaagcttttaccacgtaaggcaggtaagtcagcttaattccttgatcagccgcaacttgtttaaactgcttgcggtgagcgacaaggtttgtcacatcgacttcgtccattaatgtaacgtgtggagcggtatgttttgagttgaccatagcttttgcaatggctttgcggattccgctcattttctcgcgagtttcagggaattcgccttcaggcacttgaaccgcagctgcaggttgctgtgcagcaggttctgctttctcttcagcttgagcagccttagcgtctccggcagttcctccgtttaagaagctgtcgatatcttctttcagaacgcggccgtttttgccggaacctgaaacattcacgatatcaacgcctttttcgcgggcatacttgcgaacagatggcattgcaatgacgcgcttattcggatctgcatccgcttgctcgtttgcttccgctgcttctgcaggtgcatcagtttcttgtttttcagcttcttccgctttcgcttcgcctgattcgtcgcctttgaattgaagatcttcgtaacctggtgcatcaaatgtgatgatcgtctgcccaacggttgcgactgttccctcttcaacttttaattctaatacttttcctttaacaggtgaaggaatttctacaactgctttatcgttttgtacctctgccaaaacgtcatcttcgtttacctcgtcgtttggcttgacgaaccatttcacgatttcgccttcgtggattccttccccgatatccggaagtttaaattcaaatgccacagttctcgacctcctaagattattacgtagttgatatagtggtcggcctcttgtttaggccgactgtcagtacacggctacagtttctccgactgactgtggaaatgcatgaagggaaaaaggctgatatcagcttttcccttttgaattgttcagatctaattaaaattccaatacttttttcgcagtttcaagcacgtctttatggtttggaagccatacgctttcagcttgagagaatgcgaatacagtatcaggagcagtgacgcgaagcactggagcttcgaggctcaaaatcgcgcggtcgttgatttcggcaacaacgtttgcagctactccagcctgtttttgcgcctcttgaacgacgattgcgcggcctgttttttctacagacgcgatgatcgtgtcaatgtcaagcgggctgactgtgcgaaggtcgacaacctcagcagatacgccttctttttcaagctcttccgccgcttttaatgactcgtgaaccatcgctccgtatgtgatgatggaaaggtcttttccttcgcgtttcacatcggctttgccgatttcaattgtgtattcctcttcaggaacttcctggcggaatgaacggtaaagtttcatgtgctcaaggaagacaaccggatcgttatcgcggatcgcagagattaaaagtcctttagcatcgtacggagttgaaggaataacgactttaagtccaggctgctgtgcaacgagtccttccaagctgtccgcgtgaagttcaggcgtatgaacaccgccgccgaacggagaacggattgtcaccggagaattccagcggccgccggaacggtagcgcatccgtgccatttgtccggaaacagagtccatcacttcatacacaaagccgaaaaattgaatttccattacaggacggaagccttgtaagcctaagccgagtgcaaggccgccgataccagattcagcaagaggagtgtcaaatacgcgatcctcaccaaactctttttgcaatccttcagtcgcacggaacacgccgccgttaacaccgacgtcttctccgaaaactaagacattttcgtcatttttcagttctgtgcgtaacgcatcagtgattgcttgaatcattgtcatttgcgccatggcttacttcgactccttctctttataaatttccttttgttctacaaggttgtaaggaagctcttcatacataatgtcgatcaggtcggtcactttttgcttcggctcttcgtcagcttttttgatcgcctgcttgatttcttctttcgcttcttcaattaccttgttttcttcttcttcagaccaaaggcctttgttttccaagaacttgcggaaacggacaagcggatctttctgctcccactcattctcgatttcttttgtacggtattttgtcggatcgtcaccggccatagtatgaggaccgtaacggaagcaaagcgtttcgatcagggtagggccttcgccgtttacagcgcgctcgcgtgcttcgcgtgtcgcagcgtatacagcaagggcatccattccgtctacttgaacgccgacgatacctgcagccgcagctttttgggcgattgtttgagctgctgattgcttttcaacaggtgttgaaatcgcatagcggttgttttgaacaacgaaaatagctggagctttatacgcaccggcaaagttgattccttcgtagaagtcaccttgggaagcaccgccgtctccagtataggtgatcgccacagcctgtttgccgcgttttttcaagccgagtgcaacgccagccgtttggatgtattgcgcaccaataataatttgcggtgaaagcgcattgacatcgtcaggcatttggttgccgcggaagtgtccgcgagagaacaagaatgcttgataaagcggaagtccgtgccagatcagctgcggaacatcacggtagcccggaagaacgaagtcttctttttcaagcgcgaaatgcgtagcaatttgagaagcttcctgaccggcagtcggcgcgtagaagccaaggcggccttgtctgttcaaagaaatagaacgctgatccaaaatgcgtgtatacaccatgcggcgcattaattcttttaattgatcatcagatagatccggcattgccgcttcattaacgacttcgccttcttcattcaaaatttgaaacgtttcgaactgctttttaatggcatcgaattgctttttgctatcaacgattgcttttttcgtttttgcagccatataaagtcacctcttcctttcttttgacagtcatagacgtgtatcccttatacatacagaattagggtgtcctaaattgacgggcgcaactcatatttatttcttattagccgctttgatggttgtcgaaacttttatgtaaggacagcacaacgcgttctaaaactgtatcacttatagtttatgacaaactaatacaacaagttccaccaaggctaagtttacaccagtcgatcatgatcgtcaatcgttttcattcctgaatttcaataaatgtattcgctttatcggatttctgtttcagcgttgtcaagactgctgcaaactgttctagtatagataacaatctgtattacaatagcgatacagattttgtcgaaaaaaagagggctgaacaattcagccctctttcatctcaaaccccgcagccttgtaaaaatcttttctggctttgttgtagtcctttgtatactcattgaaatgcttgctttctttcagcactttgtcatacgattgattgatttttttcagctgctcctcaaggtcatccagtttaagccctttatttttgagcagcttgtacagctctttgtcaaggccgattgcgttttgataggcgccataaagagagtcgtatgctttgtagcgcttttccatataagatgcagcgttctcagcctttttcctgaccttctgatcatcgattttttctgccgacgctttatttgcttcaaactcctgctttgcttcatctatgctttctttctcagaattcaagtgcttctcgcgtttgccggctgtcttcagcgctttgtcggagagcgcagcgatccggtcaaaatcatccatattgagcctgatcatttcctcgtaaagcttcgattcggctttttcaagacttttaagtgaaccctgctcttgtttaaaaggctcttccaattccacgatcttctccagcgagccgtgaaacgactcgacaggatccttccagagacagcctgttaatacaaatgcagccgtgcaaaaaacgacgatgcctgcgggcacccgcatatttgaaaatttcactatgaacttcccccaatctcgacaaattccactataaaatgaattcgcttgtttgacaacagaagtctaaagatatggacaagccgatatcagatcggtatgcaaccgccttcgcttttagaccaaacctttagggaaaattccttgaagctgggcattcgactatacaacctttggacttttacatagtttatattagacgccatgcctactaaaaagaaaaggctgtgcgtaaaataacggaggaggtctttatatgtacggttattgctgccctggatacgggtacggcggcggttatggatacggctacggccgcacattcgctttgatcgtcgttctctttattttgctgattattgtaggggccgcttatttaggctgctagcccctgatggatccgtcatgaccagcctcctttaggctggtcattttatcatgcacagagattgcgcggaaagagcaagatccgctatactttacataatgaatcgttgggagtgaagatgttgatcacaatggaaaacattgtccgcgacggtcatcctgctttgagaaccgtcgccgaagaagttcaattgccagcaagcgaagaagaaatcaaacagctgagcgaaatgatcgagtttgtcaaaaacagccaggaccccgaaatcgctaaaaagtacaaccttcgtcctggtgtcggtctagccgctccgcaaattaatatcaataaacgaatgatcgccgttcatgccgaaagcgaagacgggacactatacagctatgcgcttttcaatccgaagatcgtcagccactctgttcaaagatgctatttgacaagcggcgagggctgcctgtccgtcgacgagccgattcccggatatgttccgcgctatgaacggatccgagtcaaaggaacgacgcttgaaggcgaaaacatcgacatccgcttaaaaggatatccggcgatcgtattccagcatgagatcgatcatttgaacggcattatgttttacgaccacatcgacaaagaaaacccgctgaaacaacctgaaaatgcaacgcctgtaggcaggtaaagtcataaaaaaaacggatcatttctgatccgttttttatgatttcaaaagtccgagcgcttccaccgcgtattgaatgccgtcttcatcgacgggctttgtgataaagtcggctatttttttcagctcgggcacagcgttgcccatcgctactccggttcccgcaaattcgatcatctgcaggtcgttcagaccgtccccgaacgcataagtatcctctctgtcgaacggaagtttttcaatgacttttttgattccttccgctttcgatccgcctgaaggcagcacatctgtggagcgctcgtgccagcggacgagatcaaactctttaaaccggctgtaccgctcttcctcgtcttgcgtgcagaacaagaggacctggaaaatgtccctgcccttaaagtaggtacgatcctcttccggcggattgacttttaagctgccgatcccttcatcgacgaacggatgggcggcagttgtagagcgcatcccctcttcccccatgaagacgagggggtggccgcagctgtccgaatgcgcaagcagcgcttctaacgactgctcggcaatgggatttttataaatgacctctccttcaaaaacgacatattgtccgttataagagacaaaagaatcgatgcccagttcttcaagaacaggcctgaccataaacggcgcacggcctgacgcgatgaaaacatgatggccgtgcgctttcaaatcggagacggcctgttttgcggtggcgggaatgcgtttatcgtgatcataaatcgttccgtcaatatcaaagaaaatcagctttttatccatggcagtgaatccttctcccttagctagtatgattgatggttctcctgtaccatcatacaaaaactgcgtacgcgagaaaaccttttcactccaaaatcaaaactaaatcaacatgccaataatatccatgtaacaatagacggattcatcatataatagaactaaagagatacggaagttactcagacaagtcagagaaaggaggaacccgtatgcttcgccgtctgcggaaaaaattaaaaaaacagctgaatggcatgatgcgcagaaagtcgattgcctaaaaggaccttcactcgtgtggaagggtcctttttttctcaggcgcttttcttatgagccaatttcgaatataatagaaagatgagtctaacaatcggcagttaaggagagatttggatgatctataaggtattttatcaagcaagcaatgacgaagtacctgttcgtgaaaaaacagattcaatttttgtggaagctcaatctgaacgtgaagtcagatctaaattaaaaccatacaactacaatattgagtttatacagcaagttgaaggcgcttttttagaatatgaaaagcaaagcgaaaattttaaagtattggagttatgaatgaatgaaatttgttaaaaatgaccaaacggctgtatttgcccttggaggacttggggaaatcggcaaaaacacgtacggggtccagttccaggacgagatcgtgctcatcgatgcggggattaagtttccggaagacgagcttctcggaatcgactatgtcatccctgactacacttatttagtcaaaaacgaagaaaaaatcaaaggtctttttattacgcacggacacgaagaccacatcggcggaattccgtacctgctcaaacaggtgaacattccggtttacggcggacagctcgccatcggccttctcaggaagaagcttgaagagcacggtttgcttcgccaaacaaagcttcatatcattgaagaagacgatatcgtcaaattcagaaaaacgtcggtttcttttttcaggacgacccacagcattccggactcatacgggattgtcgtaaaaacaccgcaaggaaacatcgtacataccggtgactttaaattcgattttacaccggtgggcgaacccgccaacttgacaaagatggccgaaatcggaaaagaaggcgtgctttgcctgctgtcagacagcacaaacagtgaaatccctgatttcacgatgtcagagcgcaaagtcggagaaagcattgatgatattttccgaaaagtcgaaggccggatcatcttcgcaacctttgcgtcaaacatccaccgcctgcagcaggtgatcgaagcggctgttgcaaacggacggaaggttgccgtatttgggcgaagcatggagtcggcgatcgaaatcggccaaacgctcggatatattaagtgtccgaaaaacactttcgttgaagcgaatgaaatcaacaggctccctgccgggaaagtgacgattctctgtaccggaagccaaggcgaaccgatggctgctctatctcgaattgcaaacggcacacaccggcaaatctccatcaatcccggggatacggtcgtattttcatcatctccgatcccgggcaatacgatcagcgtcagccgcacgattaaccagctttaccgggcgggtgccgatgtcatccacggagctgtgactaacattcacacctcgggacacggcggacaggaagagcaaaaactgatgctccgcctcatcaagccaaagtttttcatgccgattcacggtgaatacagaatgcagaaaatgcatgtcaaactggcgacagactgcggaattcctgaggaaaactgctttattatggacaacggggaagtgcttgctttgacaagcgaagaagcctcagttgcgggtaaaatcccgtcaggcaatgtttatattgacggaagcggcatcggcgacatcggcaatatcgtgcttcgcgaccgccggattctttccgaagaagggctcgtcattgtcgttgtcagcatcaacatgaaagaattcaaagtgtccgcagggcctgacttaatttccagaggatttgtctatatgagagaatccggtgatttaatcaatgatgcccaggaactgattgcaggacaccttaaaaaagtgatggagcgcaaaacgacacagtggtctgaaattaagaacgagattacagacacgcttgctcctttcctctatgaaaaaacaaaacgccggccgatgatccttccgattattatggaagtctaatcgcggatgcggatacagcaaaaaacggatgcaccggggtgcatccgtttttttatggttgaaccgggatatgcctgaacgctttaacatcaaacaatccttccgttgtcattttaatgtcgggaatgaccggaagcgctaaaaaagaaagcgtcagaaaaggattaaacgctcctgaaaatcctgtctctgttattgccgcgtggagagatttcaagctttcgttgaccgtctcaagcggtttgtccgacaagaggccggcgatcggcagtgcgacggattgaagctccttccctcctttggcaatggtgaggcctcctccgatttctccgaggcgttcaatcgcttttaaaatgtcttgatcatttgtaccgacagcgattaaattgtgggaatcatgagaaatggttgtcgcgatggcgccttcttttaaaccgaagcctctgactacgccgagtccgatttctttaacgccgcgatggcgctcaaccactgcaattttcaacagatcgctttccagatccggctgaaaaaaagctccgcttttcggcttggccagggacagctttgtttcgagctgattggggataatgtcaataaccctgatttcattctcttgaacgatcggaatttgcagatcatcctcatgtaaatcagacagatgcacagattgaagcagaccggatgccgctttgccgcccgtcgattggctttgctctgtcccgctccagatcacgccgttaatcatcgtctttgtaatgctcacgttctcaaaatcgctgatgaaaagaagatctgcgtcataacccggggcgaccgctcccttcgtctttaacccgaagcattccgctgcattcaggctgcccatttgatatgcgagaaacgggtcaagcccctcttgaatggcaagcttgacctggtagttaatgcttccttcatcgaccagttcgtccagatgcttatcatccgtacagaaaaagaagcgtctcacatttttctcgttgaccgcaggtaaaacatgacgcgtattctttgccgcagaaccttctctcagcatgacgtacatccctcttctcactcgttcaagcgcctcttcaggtgttgtgacctcatggtctgtaagcacgcccgccgctctgtagacattgacaaacccggctgacaagccggccagatgcccgtcgatccgcttgcccgctttatcggcatcaatgagcttttgcaccatatccggctctccagcttcaacggccacatagtccatcacttccgcaagcccgagcacctcttcgcggctgtaaaaaggatgtaaatccgcggcgttcaaaatcgcacccgatttttcgaatggtgccgcaggcacacaagaagggagcataaaataaatgttcagcctggtcatctcagcctgctccaacatgaactcaagacccttcacacctgagacattcgcgatttcgtggggatcggtgacaacggttgtcacaccgtggggaatcaccgctttagcgaattcgggcggcgtcaccatcgaggactcaatatggacatgaccgtcgataaagccgggaacgatcatttgtccctcagcgtcaatgatatttcccccctcatattcgcccaagccgacgatggccccgtctgtgatggcaatgtccgtctccaaccattcctgattaaaaacatccatgatttttccgtttttaattacagtttccgcttttttgcgatgactggcggcgccaagccggcgaatgaacatctctttgtccaaaggtatatgtcccctctcttttttatatgtatatggttcaatatcgtagccgaatcgcttgaaacagtcaatgaaaagatcaaaaaaaccgcgggctgtggggttcccgcggttaatcggtggcattttaatgttgaaagacttttttttcaaatctctcaatgtcaggatttgagccgatgacgattaaaatatcgtctttctgaatttcttcagtggcaagcggagatacgatgacttcctttccccgcttgatcgcaacaatattaattccgtatctggcccggatatcaaggtcaagcagtgtatttccggccagtttgccgttcgctgcgatttcgacaaggctgtgttcatcagaaagttccagataatcaagcacattgttggagacgatgttgtgggcgaccctttttcccatttcacgctccgggtgaacgatccggtccgctccgattttggataatactttttcatgataatcgttttgagcttttacggtaatcattttcacaccaagctcttttaagatcagcgttgtcaaaatgctcgcttgaatgttctccccgatcgctacaatgacatggtcaaaattgcgcagtccaaggtttttcagcacagattcgtctgtagtgtctcctatcacagcatgtgttgcaattttggcgtattcgtttacgcgatcttcatctctgtcgatcgccattacttcaagcccttcttcactcaatgctttgcaaatgctgccgccgaaccggccgagtccaattactgcaaattcttttttcatcggtaattcctccatgggtcaatcttgaacaaattctatcatatgaagtggaatttttcctcttttattttatagttgcgcggctgcagcatccttgctgaatgtcgttctcttcggacgccgcacctttatcgaccggaagcaaaatgtggaatgtgcttccctcgcccaatttgctgtcgattttcatttctccgttgtgggcgccgatgatattcaggcaaattgtgagcccaagacctgtcccttcttctttcgttgagaagaaaggctccccgagctttgccaagtcggcttgggaaatgccgccgccttcgtctttgatgctgattttcacatagtctccttctacctttgaggaaatcgtaattttaccgccgtcaggcatcgcttctatcccgtttttaattaaattgatgaatacctgtttgatttgattttcatcaccgtttatttcccactcctccccgtgctgaaacgctttttcgatcttaatgtgggaaagcacggcgttcgtctcaagaagcgttgccacttgctgaagaaccgaattgattttgatctttttaaattgaacctggtgcggtttggccagcacaagcagttctccgagcacagaatcgattcgtttaatctctgagaaaataatgtcaaagtaatctttccggtcaggatattccgctttcatcagctgcaaaaatccgtttacagatgtcagcgggttcctgacttcgtgagcgatccccgctgcgagctgcccggccatcgccagcttttgagactgcatggccagccgctgattcgacttaaacagttccatctccgcttttttccgttctgtcacatcagtcagcgtccccaagctgcccgtaaattgaccgtttttataataaagtttatagtgaacttcgccccagaacttgctcccgtctttgcgatggtagagcacctcgatcctgccttcgggctccttgttcttcaactgggcgatcaggtgattcgagatccgttcttcatggtcaaaataatcgttgtacatcgttccaaggctctcttcgacactgtatccggtcagggttgtccacgcctgattcagaaatgtaatgtatcctatccggtccgtttgaaagacgatttcctgaagattatccattatgcggttggtttctgaggaaagctctttatatttcttttcgctttccttcaatttatagacaagctgatttgactcatcgatataaagtgtgagccaccaaacgctgattaatgtcaccagcgtaaacagcagatcaaccgtccaattgattttatttcccaacaccccatagaataaaaaattccaaaacatgataaaagtcattgccagcacggttgcaatgattcgtccttgatatcttttcatacccccacctgccacttgtatttctcagtcaattgtaacattctttacaccacatttgagaggattgttcgaagtatttatcgtctctatggctgaatttttcagtgacggcggttttatctgctcccggcgcaagaaaaagcccttctgatgaagggcgtcgaatgttatgctttcactccgtttaaggcagctttgatttcttccaaaagcaattcggccccttcaggactgagcgtaattttcccgtttccatactcgcggttttcagaagtgatttcaccggtcatcagacacacaccgtgcggtttatattttttcaggacgattttatcttggtcgacaaagaattcgatgctgtccttgatcgagatatccaaagctcttctcaattcaatcggcatcacgatcctgccgagttcgtctacttttctcacaactcctattgctttcaaaactttcgcctacttcctctattgtttctatttttctaagatattgtcttagcataacgatagacgaatgaagactgaaaaaggtttcccttatcaagcgtttcttcgacaaaaatccggtcataaaaatgaaataattttctcatcatgtaaatatgaggacagcattttacagattggtttcaaaatcgtcacaaacccccaaaaatcgccgatgatttgagaaaatttaaatgaaattcattttttcagcacgaagaaaatttcgtttttcggaaaaattttaaatagagattgggtgaaaacatgtttcaaacaaccgagatcggaattgatctaggcacagctaacatattggtttacagcaaaaacaaaggaatcattttaaatgagccttccgtcgtcgccgtggacacggaaacaaagagcgtattggcggtcggcacagaagccaaaaacatgatcggaaaaacgccgggaaaaatcgtcgcggtcaggccgatgaaagacggagtcatcgccgattatgacatgacgacagacctcttgaagcagattatgaaaaaagccggaaagaacatcggctttacgttcagaaagccgagcgtcgtcgtctgcacgccgtccggctcaaccgctgttgaaaggcgcgcgatcagcgatgctgtcaaaaactgcggagccaaacaagtccatttgatagaggagcctgtcgccgccgccatcggcgcagatctgcctgtcgatgaacctgtcgcaaacgttgtcgtcgatatcggcggcggcacgacagaagtggcgatcatttcattcggaggcgttgtctcgtgccactcgatccggatcggcggtgatcagcttgatgaagacatcgtgtcattcgtcagaaaaaaatacaacctgctgattggtgaacggacggccgaagaagtcaaaattgagatcggctacgcattgattgaccatgagacgaaaacgatggaagtcagaggacgcgaccttgttacaggcctgccgaaaacgattaccctggaatcgaaagaaattcagaaggcgatgcgcgaatcgctcctgcatattatcgaagccatcagagcgacgctagaagactgtcctccggagctgagcggagacattgtcgaccggggcgtgattttgaccggaggaggcgcgcttttgaacggcatcaaagaatggctgtcacaggaaatcgttgtgcccgtgcatgttgctgcaaatccgcttgaatctgtcgctatcggaacgggtcgttctctcgaagtgatcgataaattgcaaaaagcggctaaataatttttgttttcgcgtcttttttcccggcttctttcatatcgtgaggaatggagaaacgataaggaggaagaccatgcttagagatatgggaagacgcctggccatcaccgttattttaagcggtattattctcggggggatgagcatctcccttgcaaacatgccaagctcgccccccggccaaacggccaaaatcaaccgttaaaaaagaagcagcctgaaccgggctgcttctttttttcttttcaatcaaatatttgatatgatgttatggacaataaaggaggttttgccaatgaattcgtttactgataaactgagcaaatatgcaaagcttgtggccgaagtcggcgtaaacgttcaaaaaggacagcaagtcgtcatcaacgcgtcaacagaagtacgcgattttgcacggctcctcgtcaaaagcgcctatcaaagaggggcgaaaaacgtgacggtccgctggcaggatgatgaggtcacaaggctgaaatacgagctggctcctgcggaagcctttgaagagttccctgaatgggaagcaaaggggcttgagacgctcgccaaagaaggcgctgcttttatttccattgtctcttcaagtcctgatcttttgaaaggcatcgattccaaaaaaatctccgcacagcagaaagccgccggaaaagcgatgcatacatacaggcaaatgattcaatcggataaagtcagctggactgtcgtcgcagcgccttcgccggcctgggcgaaaaaagtattccctgaggcagatgaagagacagccgtgcaaaagctatggaatgagattttcaaaacgacccgcgtcgaccgtgaagatcccgttcaagcgtggaaagatcacgatcaaaccttgcgcgataaagtaagcgtcttaaacgacaagcattatcacgcccttcattaccaagcaaagggaacagatttgacgatcgagcttcccgagaagcatctgtgggtcggcgccggaagcacaaacgaaaacggcgtcgagttcatggccaatatgccgacagaggaagtattcactgctccgaaaaaagacggggtgaacggcaccgtttcaagcacgaagccgttaagctacggcggcaatttaatcgacggctttacactgacatttaaaaacggacggattacggatgtcaaagctgaacaaggcgaagaaattttaaaagagctgatcgaaacggatgagggttcacactacttaggcgaaattgcgcttgttgcccacgattcgccgatttccaagtccaatattctgttttacaacacactgtttgatgaaaatgcctcaaaccacctcgcgatcggcagtgcatacgcattcaacatcgaaggcggaaaacagatgtcgcgcgaggagctggcgaaagaaggattaaacgaaagcatcacacatgttgactttatgatcggttcaggagaaatgaatatagacggaatcactgctgacggaaaaagagagccgatattcagaaacggcaactgggcgatataaagccttccgcaaaaaaagacctcagaaaacttctgaggtccttttatatcgtgtccgcatgccgcccgcaatcctaaacttccctgtacatgcatggcggctgtaacagctgaaaatcaggtccatgctccgccgcctcatcgcttgggcaaactgcttaaatgttcatgcttcagtttccagcgtcctgactcgtcctttacaaatacgtttgtcgcacggcctgccccttgaaccggttcgcccctatataaccctttccattcgtatgtataaagacagacggcctgttcgtccgtttccgtgatccagctgacatgaccggcgctgtatacttcattttcgatttgcttccaggcgttttcaaaataacgctgaatctcctcaaagcccgagcacgtttgatccgaaaaccagtacacagcgccggggtcaaggagggctttgacattctcaaactcatgtgtgtttgttgcttgaatatattgctcaagagcctttcggcatgacacagcaaccatctcctttttataaaaaaaaacccgctttttaaggcgggttttctatcattacgcgtaaagttcagcaagcttgtcctgaaccgttttatcttccaaaaactcgtcgtagctcatttgtttatcgacgattccgtttggcgtgatctcgatgatccggttggcgattgtttggacaaactgatggtcatgagatgtaaacagcatggcgcctttaaagctgattaaaccgttattcagcgctgtaatggactcgaggtccaaatggtttgtcggctcatcaagcatcagcacattggcgccggacagcatcattttcgacagcatgcagcggactttttctccccctgacaaaacgcttgcttttttcagcacttcttctccggagaacagcatccggcctaaaaatccgcgcaggaagctttcactttggtcatgcggcgaaaattggcggagccagtcgacaaggtttaaatcgctgttttcaaaatactcgctgttgtctttcgggaaaaacgcttgggatgtagtgacgccccatttaaacgatccgctgtcaggctccatttccccggcaaggattttaaagagcgttgtagcggctagctcgttccggcctgtaaaggcgattttatcctctttattcatcataaagctgacagagtcaagcaccttgacgccgtcgatcgttttcgacaggtctttgacaacaagcacatcgtttccaatttcgcgttcaggtgcgaaatgtacatacggatacttgcgagatgaaggcttaatatcgtcaagcgtaattttttcaagcagtttttttctcgatgtcgcctgcttcgattttgaggcgttggcgctgaatctggcgacgaactcttggagctgtttgatctgctcctcttttttcttattggcttcctgagccattttaagcgcaagctggcttgattcataccagaaatcatagtttccgacataaatttgaatcttgttaaaatccaggtcggcaatatgcgtacatactttatttaaaaagtggcggtcatgcgatacgacgataaccgtattctcaaaattgattaaaaactcttctagccattggatcgcctgaatatccaagtggttggtcggctcatcgagaagaaggacgtcgggttttccgaacagggcctgtgcaagaaggaccttcaccttttcagagccgcccaaatctgccattttcttcgtatgaagttcttcaggaatgccgagtccttttaataagatcgcggcttccccttcggcttcccagccgttcagctcggcgaattcgccttcaagctccgcggcgcggattccgtcttcatctgaaaaatcaggtttcatgtaaatcgcgtctttttcctgcatgacttcataaagtcgtctatgtcccatgatcacgactttcaacacttcatgctcttcatactcaaagtggttctgcttcaggacggcaagacgttcgccaggactcatatggacttcgcctgtctgaggctcaatttcgccagacaatatttttaaaaaagtggactttccggcgccgtttgctccgatcaatccgtagcagtttccgggcgcaaacttaatatttacatcttcaaacagcttccggtctgcaaaccgcaagctgacattttgaacagctatcatttaatatcctccatctatacttcattaaaatgagtataacacgaaaattccgcaagagaaatgctttgcttttttacgataaagtttgaaagaaaaatatatcaaaaaaacgcttatttccactttctttgtgacaatatgttacaattaatgaagaatgggggaaggaataatgaaattgaaagatgaccctgatatcatcagatggattaattcgaggccgcgccaagcgcttttcgcgtcagtggccatggtgatttctacgatgtctatcgggcttttcaaagggtttgatatgtggaccgctgacttttttatattttcctgtctgctgatcggcttcggcctccttgtgggatggctccaaaagatatattataaaaaggtgatatttgaagaaaactcggatcgttagacggaggaaaccatgaagcttatcactttgacggaatactgcatgtttattttttttgcaggggtctatcttgccataaccggctttacagcacgggatctggggctttacatcgggattgccatgatttacgtgttcgttcatatcgcggcgaaacgaatgctgtcaaaacggggaaaagaagccgcggaaatcagaatcttgtacagcgttcttctgattatggcctctgtgttcgttaccgtactgtttatcgcagtgctggcatcattatccgcataaatcaagcaaaaatgcctgattgtccaaatggacatcaggcatttttcagtctgtttttcggatttcgttaaacgggaaaaacacaaattgcgaagttccggccactcgttttttatcaatcagtccgaggccgttccggctgtccattgacctctggcgattgtctcccatcacgaaatacttgccttcgggaaccttcacagggccaaagtcgcccgtcagcttgacgccgactgcttccgcctcttttctgttttccgaaagatacggctccgacaccttcttcccgtttatgtacagcgtgtcatctttcatttgcacggtatctcccggcaggccgatcaagcgctttacataatggacattcttttcgtcgccgtcgataatgacgatatctccccgcttaaattcgcctacgtatctaaccgttttatagacgaacagccgctctccgtcgtgcagcgtcgggtccatcgacgtaccttccactaaatacggttcgaataaaaatgccctgatcaataacgccagaacgactgcaataataatggcttttacccattcaaagagagagtttttcttattggtggatttttcttcagtcaaaacgcttcctcctaaaaacagtctgtcacagcatacatgccaaaataaaagctttcctatactttatcacaagttcccgctgaatacataatccccgcgctcacttccggcaaaaacagtaaaaaagaaagtgccacgagagggattactgtggcactttcagcacttatttttcagttggaaccggctttttcaaaacgccgagaatcaaagctgtcacaaccgcaccgatcaagatgctgaggagatacagcagcgcatgattcgtcgtaaagaagagaacgaatattccgccatgcggcgcttgcagtgtgacatggaaaaattgagacagaccgccggcaactgctgacccgatgatacaagcaggaatgacgcgtgccggatctgctgccgcaaaaggaatcgcaccttcagtaataaatgacaagcccatcacgtagttggtaattccggcttcgcgatcccgttttgagaatttatttttaaagaaagtcgttgcaagggcaattccaagcggaggcaccataccgcctgccatgatggctgcgtgaggtccaaagtttccagcttcaatcattgcgataccgaatgtaaaggccgctttgttgatcggaccgcccatatcaatcgccatcataccgcctaaaacaatacccattacgacaaggtttcctgttccaagaccttcaagccaatgtgtcatgccgtccataatgtacttgacaggcgtattgacaacatattgcataatgattccggtcaagaatattccaaacagcgggtagagcagcacaggttttaaaccgtcaagcacttgcggcagaccagcgaacacttttttcaacaggacaacaatataaccagctaagaaaccggcaatcaggccgcctaagaaacctgcgccagcttgtgtcgccatgaaaccgccgaccataccaggcgcaaatcccggacgatctgcaatgctcatcgcgataaatccggccaatacagcgacaattaatccaagtgcattcgttccgccaatattatttaatacagcagcgaactcattataagtcggatctcccggcttggtcgcgttaattccccagaagaacgaaatcgcaactaagatcccgcccccgacgacgaacggcagcatgttgctgacaccgctcatcaagtgtttgtagaaaccgccgccttttcctttggcagctccgtcttcagaagcggttgcaccgccgcctttaccctgatagataggcgcgtcttgtttcagcgcctgctcaatcagctcttgcggacgtctgatacctgctgttacaggtacttcaatgacatgcttgccttgaaagcgttccatttcaacctgcttgtcggcggcgacaatgatcgcaacggcatcttcgatttcctgggccgtcagaccatttttaataccgcttgaaccgttcgtttcaactttgatatcaaccccaagctctttcgctttttctttcaaagcatccgcagccatgaacgtgtgggcgatccctgtcgggcatgctgtaaccgcaaggatttttccttttgctgatggtgcaggagcctcttcggcctgctcttcttcttcatcatcatctttatcatgctgattgatgatgtcgatgatttcgtcttcagatgaagcttcaagcagctgtttgcgaatctcctccctcataagcaaagtcgacagtcttgacaatgcttcgaggtgagtgttatttgcaccgtctgtagcggcgatcatgaaaacgagatggcttggctggccgtcaagggattcataatcgacgccgccttttgaacggccgaacgcgatcgcaggctctttgacgcttgccgttttcgcatgcgggatggcgatgccttcgccgataccggtagagctttgtttctcgcggttgatcacagcttctttgtagccttctttatcattcaacttgccagcctgatccaaaacgctgacgagttcttcgataacgttttctttctggctgctctcaaggtttaacttgatcgtatgctttgttagtagctcagttattttcataacctttcctcctttatatcgctttgacttgaacttccggaagcagcttgtgaacgagctcttccgttcccagctcctctgaaaaggcagttgcgcttcctgaagcgactcctaagcgaaaagcttctttgatgccaagctgtttttcaatgcctgcgagaaagcctgcaaccactgaatcccccgcaccgactgagtttacgagctttcctttaggtacgttggcatggtagacaccgtcttttgtacataaaagtgcgccttctccagccatggaaacgatcgcgttttcagccccgcgttcaacgagtttctttccgtaaggcaccgcttcttcggccgaggtgatagttgttccaaacatttctccgagctcgtgatggttcggtttcattaaaagcggcttcatttctgctgcttttaaaagggcctcacccgaaatatcaacgacaacccggacattttgctctttgcatttttccgcaatcttttcatatgtgtcctgcggcaatgatgaaggaatgctgcccgccagtacaacaatgtccccttctttcatcgctgaaaactggtctaaaaaggccgcgaaatcttcttcgctgatgaccggcccctgcccgttgatttccgtctcatccccggtcttcaatttgacattgatgcgcgtgtcgccattcacctcatgaaaagccgtttcaagcttctcttcttcgagaaatgatttgatatatcccccggtaaaaccgccgataaaaccgagaacttttgaaggtacatggtgtctgttcagtacgcgtgagacattgattcctttgcctccgggatatttcgtgtcatagactgaacgattcagcccgcctacagaaaattcttcaacgtgaacaatatagtcgaccgatgggttgagagttacagtgtatatcatgttttcactacctttacgacagttttttcttgatagttatcaaatgaatgttttgcagatcctgctgtaatgatagttgcttcgtctaaaccggcaaaggcagaaaatgaaatttccccaaacttggaaacgtcagctaaaataaatgcttttttcgcctggttgacagcttttgttttcaaaagcgcttcttcaggatccggagtcgtgaaccccgcttccttatgaatgccgttgacgccgatgaagcttttgtcaaaccggtattggctgatggctgataaagccgaaccgcctacgatcgctccggttttatacttcacatacccgcctaataaataaaaagtaatgccttttttacctagtgcctcaatgtgcatgactccatttgtaaccacgataatatccatctctggattgataaaatcgatcatttgcaatgtggtcgttccggcatcaaggtaaatacaatcgccttcttcaagaagtgaggccgcttcttgagcgatttttcgcttttcatgaaggtttttggatgatttctctagcatgtcaggctccgtacgaatatcggaaagccttgatgcccctccatgaacacgctttaaatatccgcgggcttccagcgtcgacaaatctcttctgatcgttgactcagatgcgttcgttaaattcattaagtactggattttcacgacatcatgcttttcaatctcgtcaataatcagctgatgccgttcgggagtcaacacattatcaccccttttggaaacgccttcattaagcttacaatttcattgtaaacgctttttcgacataactcaacaaaaatctttcaaattcattcaataaccatcaaaatctttcacattttaaaatattaacgtgatatgtaccgtttgtaaactgtataaactataaaaatccgcaaaaatatgtgacattattattatctattccttcaaacatcattcaggtcacaggataaaaccccatgctcaccgcatgaggttttacagcaaatctgtatcctgtttccgattactgaatattttctataaattgatatagtaagacaggccgcaacatggatataaatataaattgaaatgccgatccatcgttctccggctgctgatgcatattccaagtagatttaatagaggcttctcggccggaatgtagccaccaagcaccaagcatccctttatataggcatgtttaaccggaacatccatacaccatatgcctgatcaaatttgcttttccataaaaaaaccgcctgctcaggcggtttcaatattgtcgatagtctgacgtactggcatggaccattcgtgcatttgggtttttcctgcaactgcttcaagtttctcaaccatcttactcatacctcaatgcatcaatcggatgaaggcgggccgctttattggccgggatgagtccaaagataatcccgatcgccatgctgaacaggacgcctccgaggaccacctgccaggaaacgagcggcggccacccggcaaaaaacgatacgagggctgcaccgccgtatccaaggccgatgccaaacaccccgccgatcagtgtaattaaagacgattctattaaaaattgcatcagaatctggcctcttgttgcaccaagcgattttcgaatcccgatttccctcgtccgttcagtgaccgacaccagcataatattcatgacgccgatccccccaacgagtaaagaaatgcctgcaattgaaccgatgaacatcgtcataattgttgtaatctggctgattccggccgctatggcctccatgttcatcacttcgtacgagtccgaagtgccgtgattcttgttgacggccgctgcagcccgcttcccgacggcctgcagatcgtcggcagactcagcttgaacggagacagagtcatagtcgctgatgccgaaggacgattttaacattgaaaatggaacatacatctcattcatccccaatgcaagcagcccggtttcttctttcaatacgccgatgatttcaacaggttggctatttatccatacgacacggccgagaggcgactgctgagaaaacagttcttccgcaagcttcggcgaaataatggcgaccctgcttccagcaaggtaatcctcttctgaaaattctcttcccttttcgatttccatcgaattgatgctgatatatccgtcattaatgccgtttacagcggcatccgtattttcatcccggaagcgggcattcatggactcggttgttttcgcaacgacatgtttcacgccttcgagtgactttaagcttctgatgtcttcttcggtgaagccggcgtctaagtaggcgttcggattggcggttaattcttcattgctgggctgataatagatttcgaccgtgttgccgggtccgctgatcgtctgcttgagcatctgctctcctccttgccccgctgcaacaacgacaataacggagcctacaccaataatgattccaagcattgttaaaatcgatcgcagtttatgggaaaggatggaacttaaagccattctcaagttttcgatgagattcattgcaccgtccccctccgctctgtttccggcgagacgatcacaccgtccctcaccatgatggtccggcttgtatagtccgcaatttcaggttcgtgtgtgacgagcaccaccgtcgttccttcctcattcaattcggtgaattgctccatgatgtcccggcttgttttcgtatcgagcgctccggtcggttcatcagccaatatcagtttaggttcattgacgatcgctctagcgatggctacacgctgtttttgcccgccggaaagctcgttcggcatatggcgcattctgtccttgagcccgactttttcgagcgcccgttcagcccgctcccgccgctcctttcttggaacgccgccgtaaatcatcggaagctccacattttttatggcattcaagcgcggcagaagctgaaactgctgaaaaacaaaaccgattaaacggtttctgacaccggcaagctccctttcgccgtatgatgaaatatcctcgccgtccagcctgtaaatacccgatgtcgggcggtcaaggcagccgataatgttcatgatcgtcgattttcccgaaccggacggccccatgatggacagatattctcccggctcgattttcatatcgatctccctgagaacatcaatggtttctcctccgatttggtagctttttttcactttggaaagctcaatcattgaagcttcacttccgttccgcttttcatatcctcggccgggtttgcgataaccgggtccttgtttgtcagaccgccggtaatttcaacgaggccgtctgctttctcaccggttttgacattgatccgttttgccttgccgtctcttacggcaaacacgtatgattgatcaccatcctgcttgacggcatcttcaggaagagcctgaacgattcttttgtccgtctggattttgagaatcatgttaaagccggactttgctttaggacgctccccttttattttgacttcaaacggatattgaacagcttgctcctttgttcccgcagcacctgcagacgcctcttctttgggaaccaatccgacttgtgatacccttccacgccactctttattttggatgacatccgacgtgatggtcacgttctgtccctttttcactttcaatgtgtcatactctgagagcacgcctttaacgacaagcttgtcctcgttacctatatgtataaccggcttttgaatatccgattgctttgcagcggcttgtttgtcaacggtaataaccgtcccgtcaatgccgcttttcacttgcagcgctgccgatttcttctcgagcgtttccttttgcaggtcggcttgtttcagttcaagctggagcgatttttcttccatttcaagctgtgaccgttcttcatcaatttgcctcttggctttttccgctccgagctcagccttcagctcgtcttccttgctttttaggctgctgatttttcgcttaacctgttcaagctggagatccttcgattgaatggataaagcgttttgctccttttccaggcgaatttcttcatttgtataggtgaaaagcacatctccttttttcaccttatcgccttcttttactttgatgtcggcaatttctcctttttcaggttcaaaatattcgtattgttcgtttgcaaactgaagggtccccggaaccatgacttcagaagaaatctctttttcttccaatttcacggtttgaaccgcttcttcagcccctccgctcgtttgaaccgagcggtagaggttgagtccgataaaaagcgcagcagccccaacaatgacgatgccgatccatatttttttcatttacattgctccttcaaatgaatcgaagaaattgatcgccataccgcctattaaagcgagcagaatggagatcacaaataaaatgatcacaccggtccaagccgcttttttggagatgcccccaaccttttggagacccagggcaaccaatgagagcgaccagatcgtgaaaatatcaaatacacccaataccgatttgagcggctcgtctgccgggatgatgccgtttaaagacgtgacgacgatcgtgggatcgatatttgaataatagatcactagtccgcctatgaattgtccgatagccgcaataaaatatgtaaaaacagacagcgaaaacatgtgaacaaaattggttgttcctcttccgattttgacaatcagccaataaattaaagcgctgatcagcaaggcaatcacaaagccgaagatcccgccgatgatgccgattcccttcatagcagcttgaaatgcttcagcatccggcatttccgacaaatcggtagacaacgccgttttttcgctgagcatatacgctcccgcaaccgacaagattaaaacaatgacaagcggaaaccagaaagccggcttttctctcattctctcgaactgttctccgggccgggtaatcaatccgagcaatgatggattctttactttttcagtttctaaattcgtttccatatgtatcccccttaaaaaatgaattaccagtttatacgcagaatgtcctaaaatgtttcacaactgttctcaaaaaaacgccccggccgcattcttagaaggtgcggcgcggacggttttagtttcgctgaaacatttgatactgcgcttttaccagctcataatacattccacgtttcccgatcaattcctggtgatttccttcttctattttccggccgtggtcaagaaccaggattttatccgcatcccttatcgttgaaagcctgtgagcgatcataatagccgttctgccatggagcagtgttttcaaggcagcctggattttgacttccgtttctgtgtcaatgcttgcggttgcttcatcaaggattagaatacgaggatctgccagaagcgccctcgcaaatgaaatgagctgccgctcacctgccgataatacattgccgcgttcttccacttctgtggcgtatccattcggaagcgctgaaataaacgaatcggctccgacagcttttgctgcttcgatcacttcttcatcggcggcgttcggacggccaaaacgaatattttccataatcgttccggaaaaaataaacgtgtcctgcagcacgatgctgatttgcgaacgaagatcggaaagcgagatatcggtaatcggtataccgtccactttgacagccccgcctgttgcatcgtaaaacctgctgatcagatttgcgatcgtcgtcttccctgatcctgtatgtccgacaagcgcaagcgatgatcccgcaggtatctcaaatgaaatgctgtgcagcgccttgcggttcccgtcataagaaaattccacctgttcaaattcgatccggccttttaattcttttattttgaccgcatcttccttgtctgcaacgctcggcttttcatccagaaattcaaagatccgctctgacgaagccatccccatcaacagctggttgtagacttggccgagccttgaaatcggctcccagaacattccgagatagaaggcgaacgatacaaatacaccgatcgtgatcgtttcattgatgatcaagcttgagccgtaccagattaaaatggccgtcccgacagcgtttgtcatttctacaagcggacggaaagtcgcattttttttcgtcgcttcccgccaggcttcaaagttctcactgttgacgccttcaaaatacatcatattctctttttcctgagtaaatgcctgagtgacccggatgccttgaatgctttcgttcaaatgggaattcagcttggactgctttaagcgcaccttttgccaggatcgccggattttccttctgagattagtagaaatgaagaacatcacaggcagcgtcaccataatggcgatggtcagctcaggactgagcgagaacagaatgacgacaattccaaaaagaagcaaaatatccatcaataaattgatgactccgctcgtaaacagttcctgcaaagaattgatgtcattcatgatccggacaaggattgaacctgccgaacgctcgtcgaaaaagcggtgcgacagccgctgaacatgcgtaaacaaatgctgtctgagatcatatatgacatgctggccaagcttgttcatccagcggattctcagcacattgctaacataattgacaagatacaacccactgatgacggagatcagaatcacaagaagattcatatcccggcctgcgatcgcttggtcgagcgcatagacgccgatcaaaatcggcaccgccagccggatcgccgccgagatcatgaccgttaaaaacgacagcggcagcaaattttttcggtagggctttaaatatttaagcagcctccacatctgcgcccagttaaaaggcttttcaatgatttggtctgaagtataaaaaaaccggttcatcaacgtttgttttttcgcctggttttccatagcaagagcctcctatcctgcaaaatgcggctcattcaacacattttgatctttatactgcaaatcaaaaatccgtttgtataaaccgtttgcttccattaattgttcgtgtgttcccctttccttgactacgcctttatcgagaacaaggatttcgtcggcatgctttaaggatgagattctgtgagcgatgatgaaagtcgtccgatcccgcatcacttcccgcaatgcaagttgaatgcggtgctccgtttccatgtcaacggcactcgtcgaatcatccaggatgagaatgcccgggttcatacaaatcgctctcgcaatcgcaatccgctgtttttggccaccggacagcccgagccccctctcgccgagcatcgtatcatattgattcggaagctccatgataaaatcgtgagcctgggctcttttcgcgctttcgataatctcatccatcgatgcatcaggctttccatacgatatatttgacctgatcgttgaggaaaataaaaacgattcctgcggaacgacgccgatattggagcgcagcatctttaatgagtagtgttcaagcggtttgccgtcgatcgtgatccggccggatgtcggttcataaaagcggctcagcagttgaatgatgctgctcttgcctgaccccgtcgcgccgattaacccaattgttttgccgcgctcagcctgaaaagacaccccatgcaatgcttccgcattttcttttgtatattgaagggaaacatcgctgaatacgacatcgccgttcagtctgccgcttttcaccgcctgttcggtatcggtgatttcctcctcggcatcaagaatttccagcagccgctctcccgatgctttcgcttgtgaaaacaggttgatgacataaccgaggttcatgatcggccacatcaagtaattgacgagactgaaaaaagcgacaagctcacccggttttaagctgttctgcatcacgagccagccgccgaacgacagcagagccacgaggcagatattgccgataaactccatcagcggaaagaacttcgacatgataaacgaagcgtttaaatttttagttcgaaaatggtcatttgaatgagtaaagttttgaatctcaaaatcttcttttgataaagatttaacggtgttcatgccgctgatattttcctgaaccttcgtatttaaacgggcgaatgattttcttatgttccgaaaagcgggatgcacttttttatcaaaccggtagacggccgctcctaaaaacggcagagaagcaatcgtaaccagagtcagcggcacagaataagaaaacatgacagacagactgaaagtgacaagcaggataaatcgaatcgcctcagcaaagccgaaagataaaaagaatctgatgccttcgacgtccgccgtaagccttgacattaaatctcccgttttagcgctgtcgtaatatttgaacggcagacgctgcaatttcgcatacagctcttttcttaaccggtagacagagcgaattccgaacatatctccgagatactgatgaaaaaaagtggctgcgcccttcgccgccatgacagcgatgaacccgaggctgatccatatgaccaaaccgtattttccgccgagaattacttcatcaattgtcatttgcagaataatcggataaacaacggtaatcgccgtcattagaagcatcgacgcaatcgaccataaaaacatttttttataaggccaataaaaatcttttagttttttaagggactccattagcaccagcacctttccaattcatgtaaaacaaggacacatcatctaatatatcggtttacgaaataaaattccaccgtttttaaaaaattcagtcttattatggagttttcccccttcttcggtttgaaataaagcctgtttaaaatgtgacagccgataaaaaatagtttctcgatgtcaaaggaaattttttgatgaatgaaggaagatgatgtaaaataatagaaaaagttatcaaattatgaatgacggagttgattgcaatgtcgaaaagagaggctttaaaaaaacggcttctcctcttaggtgaattggaacaaaaaatctggaaggacttccggaaagaacgcgaagggatttatgcaaggttgggagaacttgacagacaaatccagcgacatagacgttccaataaagagtattatgcagcacattgcgtagacattattaaacagcaaaaaggagaaattgtaacgacaaaagaactgaaaatgaaactgaaggaaagaaccaattttaacgttcaccgtattagtgagctttatgacctgattcaaaaattagaaccaaacatttcgaaagaacggcgcggctgttttctttatatagagaacggttctaaaaaaaacgtcggtcggtgacaggcttatgcctgaaccgaccgacgttctcatcctccgctgaccgggggaataaaagcaaccgtatctcccgactcgacctcactgtttcctcttctgtacacttcgttcacagcgatcatcgcccggtccgtcccctgaagattgtacgtttcttttaaaaactgtctaatctcgtctgttgtcgtcttttcttcatctatatcgatactctgcgcacccgcttgttccgcaagctgggcaaacagcaaaattttaatcaatggtcagcacctctttctctgccggaagccgcctcttcaatatccggtttcccttccgggtattcagttgtctcaagctggtcgccgatccaagtctcgccgtcctcccaatgttcttttttccaaatcgggacgatttgctttattctttcgatcgcatattcgttcgcttcatacgccgctttccggtgaggcgacgacacggcgatgacaacggccgcgtcagaaatgtccagcctgccgatgcgatgggtaatggctgcagctgtgccgggccatttttcattgatttctttgccgatctgagcgagcatgctgaccgccattggaacataagcttcatattcgagatagagggtcttttttccgttggtccattctctcactgttccgataaacgtcgtgacggcaccggcttcccttctttcaacttttttgacgacatcttcgatgacaatcgggtcttttgttatgataaatcgttcagacaaacgccttcctcctttagatgattcagaataaaagccagggcacccgggtcttcaatatgaaaggatggaacatctgttttcggctcgctctgctggtaaatgacggcgatgatgccgtccaattccttcaggagccggcagtccgcttcgtttctgaccatgacaactttttgatatggcgcatgtttaaatccttcgatgaggagacactcaactgctaaaacgccgtaagcggcaatcagttgatcaagcgtccactcgccgcgcgccgtaagctgaaaaacgcccgcaccttctacgccggacgcagccgctccagcccgaaaaaagcggtcggaatccttcccttcggcaaaagcgtccggttctcctccatgtccgtggtgtttcagacagccaacattgactcctagctgatcgagctttcccgccaatttttcaacgaacgtcgttttgccgctgttttggtaccctacgatctggaggattggaaaatgtgcggccacagctgttcacttccgttctcatcccggtataaaagaacatgcactcttgccccggcttcaaagcctctcgttccgcccggcaaaaccatcagcgcattggcatctgcaagagacgttacggcgctcgatttatccagaccgacaggctccgcctgaagcgcgccgtcttgaatggatacaaacgagcggacaaacctcgtaaacgggttaggttttggaaaatccttggctaaaaccgcttctgcacataaagaatacggcttcggatgatgcagccaggtgcgcagggacggcttgacgaaaagctcaaatccaacgaagcaggctgacgggttcccggacagcccaaacagcaatttgccgtttaattgagcgaccgtcgttacacttccgggacgcatcgccactttattaaacaggacctcggcaccgagcttttcgtaaattgccggcagaaaatcaaagtcccctacggatacccctccggtcgtaatcagaaaatccaccttgtccaaagctttttccaccgctgcaaagctttcgtcaaattgatcagaaatctttcctaaataaaggggttttccgcctgattcttcaacctgagcggccgccatgcctgcattgctgttgcggatttttccgggaacaagaggatcgctgacattcagaagctccgtcccggtggcaatgatgcctaccacaggctttttgactgcaggaaccgctgcatatccgaatgttgcaagcaaagcgacaacacccggcgttatccgggttccttttttcacaagaactgatccttttctcgcatcttctccggtttttgatatattttctcccggctgtagtgagcgcttcaacaccatatagtttttgccgtcttccgagaaggtttttgtcagctcaagcatgactaccgcatcagcgccctccggaatctgcgctcccgtcataattctgacggcttgaaaagaacccagctttttatccgatacggccccggctccaatgtgatcaaccacctcgaattgcagcggattttcccccgaagcaccggctgtatcgcatgctcggacagcaaagccgtcgtatggcgaacggtcaaaagcgggtacatcgtgatcagccttgacatcttcggctaaaaatctatggagactctcctcaaggtgaatccactctgcatctcccagcttctggtgctgagagacacgcgcagcggcttcaaaaactggaatgggcgttcttttttcaatcatttaaaaaaacctcctgttgttacattccgatgactctcgccaatatggagttggcttcttttatatcatttgtgccgtgaacaagggctcttccatcgttgaaaataacgattctgaacgcctcatattgtacatgcagcaaataatcattcgcatccacttttccgatgaccgaaagctttttcatgagctcctctttaggcagccgttttaacatttcgctgcgaatttggacggtctctcttccgcacagcacgtcggctttcttttggctcatgttgctgaggaaaggataaaccggcgtttctccgcacgaaggacatttctcattgcggccgatctgcatgcgataatgggtgttcgcccataaatcaaacgtgacaaaagcagtttgaagcgcttcttgctgtccagttaagatttttaaaatttcagcttgctgataagccgacaccatttgaacggccggcgaaataatccccgacgtatcgcatgtagccccgccaatcggaacatcttcaaacaggcaggcaaggcatggcgttttttggggaataatcgtcatatacatgccctgactgctgacacaagcgccgtaaacccacggagtacccgtctcctgcgcaaggtcattgatgatcatgcgggtctcaaagttatccgttgcatcaatgacggcatccgcctcttcgatcagcggtctgagtgtttcaactgtgccgtctgcaacatatgtacgaagctcaacaccgctgttgatctcggaaagacgttcttttgcagccgccgctttcggaagcctttcctccgcgtctttctctgtgtagagctgctgcctttgcaagttgctccattccacataatcgcggtctataatagacagtgcgccgatgcctgcgcgcacaagcccttcagcggctgacgtgccaagcgccccggccccgacgatcaaaacatggctctgcctgattctgtcctgacccgcctgtccgatgttttgatatctgatttgtcttgaataccgttcatgcatcaggatgatcccctttacttccttttctatatcataccatttttccgtctgctgttctttgaaaaacaccttccgaaaaacccttgcaatctatgataaaatatttcatcccggaaagaacggctctatttcttctaaatccgactttttattgacatttataaattcccacggctctgcaccaaccgcatctgcttcaatgtacttgacgcgaatgcggtcgagaaaactgctgatcttcagttcgttctgctgaagctgttcatggaggacggattttacccttctgtggtagacggcaacaagcggctgcgcccttccgtctgcgacaggcacgacggcgtcatccgccggggtcaactgccgttttaaagccgatatggtctcctgccggacaagcggggtgtcacaggccgaaaaaatatagcattccccttccgcccgctccatggctgtgtacataccggcaagcggccctttccctctgtacggttcgatatcttccagcaccgctttttccccgagttctataaaccgctccgtcaagcccggacggctcaatatcaggacgtcgtctcccagcgcctgtttgcaccattgataaagcggcttgcctttccagcgggcaaacgccttcggttccccaaaacggcgcgaaagcccccctgataatatgacatgtatttctttcatacggctcaaccttccttcgcgtgttcctgcctgcgaacatcatagcaaaactttagaaatccgaacaagtctgtaaaatctctttttcaaaaggcatggcgggtttcatttatgcatattgtagttgtaacatttatagggggctggtcaccatgaaaaaaacatcgggttcgctgccttattttcaagatttatcacaggaaaacctttttttaaaagctgagctggcaagatcacatcaattgatacacgagcttgaagcaagctattttcaccagaaaaatcataagctcagccgggaaaacgcagcaatgaaacagcagcttcagcagctgtcattcgaactggagcggatttcggcaaacaaggaagacaagtcggccgaaacgctcaaccggataaaaagcgaattgctgagtaaaatcgtcgttcttcaggagcttcttcaaaaagaaacctatgcaagaaaacaagagatagaagaaaagcaccgccttcatttaacaaatgtaaaagccgaagaagagaaaaaaagcttacatagccaaatagaatacgaaaagcttcatgcagaaagagaaaaaacgctgagggaaaaaaaggaacaggagctcaaaaacgctgcatacgaaaatgcccgcctgaaagatgaacttcatgctaaaagtcttcagctcaaacaaatcgaaactgatgttgcggtattaaaagagcgggtgacggaaacgaaaagccggcttttggaggctgaaaaaacaaaagaagcgctgttttatgaaacgattctctcttataaaaggcaactcgatgaaagtgataagtggatcgcttctcattttgccgatattgatgcatttcagcagacggagaaggcgcttgaacaaaacgaggaggtttttgaacggacagaacagatcgaggcggtgcttcaaactgttacagagcaagttgatcagctccaacaacaattgagcgccattcaacaaaatgatacgaaaatggatcaaaaaataacagaatggaaaaaacaggcgaaagaagaaacacccccgcaaaaatgggtctatcaaattaaacgcaaagacaaagaaacaaaacctttaaattaaataccactttaaggaataatttggtttttacaaaaaaaccgcttgagtagattgtctcaagcagttgattgggcggcgcgtataaagcggccgcctttatgttcccttaaaatggaaacgctatctgaaaaagcaagggtttgacctattgctgctctgtctcagtagaaatctcaccctctaatatatattgaccgcggtatggttttttgacttccgggtacattttaatcaggctttgcataaaggttgtcatattagggatctcaagtccgctctctttttcgatttctttttgaagttcggagcttttgatggccgcattatggcgttttaatgttttaatcgccgcttcacgcaattttgcagcttttgagcctggacgtgctgtaccccttctgcgtcttgtcgttccatctggaattccggcaggcagtgaggaggtttgcggagaagtctgctgctggttcttttgagatgcttgcggctgctgttgctgctgttgctggtagctcttcatctcctgtgcagccaattcagctaaaacagggagagattcagttttacgctccgggcgaaaatctttttttgtatcattaaagctggatggacgatccaattcacgcagctttgcatatatgttatcccgctcaatttgatactccctaatcaccttaacttcagcctcgttcagctgctctaatcttaaacgcaatgcttccctctcgttaaacataccgtttataccctcctatcagaataaataaaccttccaataaaaatattagattaccaaactaattttatcaactattttttcgtttttctactgttgctctccgttaagaaaatagaactaaatttccgaaaaacttgaagcctgaggagtttttgaagcatttcggcctattctaagctcattgtcgaaaaatggtaaataatgaaggaacctagaaaattacttttcaatgaaacataatttaggaatagaatccactgtttaattatgatggaaagtgtgagatatcaatgattattccgccttataaatccagaatatttaaaatttccagatttcacttgtcgaatccacagtcttttatgcacggggtaagtaagaaatgctcccgaaccaaaaacaggccaccagactcatcaaatgaaataaacagtgtcaaatggcctatttgtcgaaaggggaggctagaggaaattttttttgtttttttgtaattggggagccaaataaataaaaaaccccatgaaaacggggtttttcatctttattcagcagactgttctgtttcggcaagaacgcggttcacacgtttttcgagcattttcattccgctgcctccagcttgaaaatggcgaagctggcctgttttgtcaaacacgtaataagcagggacatattcattctcaaaagcgtcagtcagcttatggtcgctgtcaacaaaaataggctgagtgatatcatgttcagcggcaacttctttgattttattcaagtctaaatcgtcttctgaacgcggcatatgcacggccaccacgtttagtttatcgctgtagcggtcgcggaattcattgacctggggcatcgcctctttgcacaagtggcagctgatggaccaaaaatgaattaatgtcggcttttctcctataagctgctcttttgtcacttctccgtttaaccactcttttgcgccggtcagttccggcatcggctgacgtaatttcatgatttttcctccaatgtcatttttgtcgtttaaaaaggtctaacaaatgttagacctttccaatcagatttcttatcgaaattaaagggttgcttgtcccggtttccagtttgcagggcaaagaccgcctgtttgcagcgcttgaagcacgcgcaatgtttcgtctacatcacggccgatattgttatggaacactgtttgatattgaagttcgccttctggattaatgatgaacaatccgcgaagcgctacaccttcttcttcaatcagtacgccgtattcacgagatacttcatggtttgtgtcggcagcaagcggatatttcagctggccgagaccgttatctttgcggtccgtgttaatccatgccaagtgagtgtggatggtgtcagttgatacgccgataacttctgcatcaaggtcttcaaactcgtcatagcggtcagacattgctgtaatttctgtcggacacacgaaagtgaagtccattggatagaagaatagaaccgtccacttatcatttttcatgttttcttcaaggcttacttttccgaattctttgtttgcaagaaccgcttccatttcaaagcgcggcgcttgtttacctaccatgcgttctgccattttatgtatccctccaattgtgatttttgggttatgctacccgtatctaaatgagaattcaaatattaaattctcatttagttaataatatcacatacatagttcattataatgcttaccatattttaagtcaatattaattgataataaatttaaattagcggttgttctatttaaatcctttaaaaaaattgtaacatgccgccggatgaggaaacaaccgtttaacacgcagcagctgttttttttggaaaacaagttaaaaccgaagctggaacttcggttttatgtctattactgaagtttttgctcaacctgctgacagatttcatcggcagttaaacccgtcgcctgtatgacagatgctccggtcatcgtatctgaaatcccgagcatatcagtgtccagaccagtgacgacgcagcagtcgcagccttttgcatcgtcttcggttttcatcgttacaacctcataccctttttccttcaaagcagcctcgacatcagaaagagattgttcgattccgatttttttcgacatgaagaaacacctccaccaattaagatgccacgtttgccgattttttataccagccgctttatctaattggctttggaagagaaataagccgtcatgacgcggactgccgtttcaagcgcttcctctttcggctgcagcttggcgtggtgaagcccgtaaggtgaatcgacgccgagccaaaacatgaagcccggatactttttcagcatatagccgaagtcctcccctgtcatcgcttcttttgaacggacgacctctgcaaggccgttttcagaaacgaactgcataaagtcttcgactaaatcgcttgaattgcagacctgataatatgctgcaggatagctgactttaccgctgcattgataagccgtttccaggccccgaaccatggcctcgatccttttcttcacctgttccattgacgctggggacagcgtcctgatcgtcccttcaagccttgcttcctgagcgatgatgttttgtgccgatccgcctgtaatcgtcccgatggtaatgacagcactgtccagcggatcgacattcctggctacgatcgactgcatttgcgtaacgagcgaactggccgcgaccaccatatcttctgcaaggtggggatatgcggcatgcccgccctttccttcaagttcgattacgagctccgacgtattggcaaagagcagcccgcttttcgttccgatcgttccgaccgggagttcaggcgcgatgtgcagcgctgtgatcatgctcggctcccactttttaaacaagtcgctttcaagcatcggctcagcgccgcccggtccttcctcagccggctggaacaaaaacagcagatcttgtttaaccgggtggcggacgaaatgatcgatgatgccgagggcaatcgtcatgtggaaatcatgcccgcacgcatgcatcctgtcctgatgaacggaagaaaaagaatatccggtatcttcccgaatagagagcccgtccatatccgccctgtacgccaaaatcttttcaggggccgtccctttaacctttacaaacagtccggttctccacttttcaatttcaatccgtccttccggatgctttgctaagtggttcaaaagataagcctgtgtcttatattcctgaaaaccgagttcaggaatttggtgcagatctctgcgaatcgctgctaattcgtccaatttcatctttctaacctccccggcgatgcgaaaatgcgtggattgtcacatccacgcacttttcgctgccgcttctaaagctggcgcaattcctgtttgatttctgttttgcctttagttttttcatcgatgtctttgatttttttcgcaggtgttccggcgactactgtgtaaggctcaacatcttccacaacgatcgcgccggcagcaacaacggctccttttccaacagtcacgccttcaagtacgacggcgtttgcaccgatgacgacatcgtcttcaataacgacaggttttgctgaaggaggctcaatgacacccgcaagcacggatcccgctccgatgtggcagtttttgccgacggtagctcgtccgcccagcacgacattcatatcgatcatcgttccttctccgatcacagagccgatgttgatggaagcccccatcatgatgacggcattatcgccgatttccacttgatcgcggatgatcgcacccggctcgatgcgcgctttaatattttttaaatcgagcgttggaatcgccgaattgcggcggtcgttttcgatgacatagtcttcaattttgcctttgttggcttcgagcgcagcttgaatctccgcccattctccgaatacaacccctgtattgcctgtaataaaaggcttggctgaagcgccgaagtcaattccttcaaggtcgcctttcacatacactttaacaggtgtcgatttcttactattttgaataaatgagataatctcatttgcatccatcattttcattatgtaagtcctccttctctttttctcctcattactgtatcaaaggaaagatttaaaaacaagaaaaaaaggaaagggatgtcccgtttccttttttatcaaaagctatgccggcacttcacatttctttgcaaaatccctgccgaattggagcagcatgccttcttcttcatcctccggattcatttcgattttgacggacggaagcaccacgttcccgccgagctccttgattttatcttcaagaatgtcgacggcaccgcaaaaatgctcgtaagaagtatctccggatccgaaaacggcaaacgtcttgcctgtgaaatccatcccttccatatcgtcgtaaatatccaaaaactcatccggaagttctccgtcgccccaagtataggcgccaaatatcatgtgctgataatcgttaaagagcgccgcatctacatccatcgcttcatgacggtccacttcggccccgccctcaagaaggcccttctcgattaaatcggccatcgcctctgtatttccagacatgcttgcataaaccagcaaaactttccccatcattattcctcctataaaacgctataaaatcagtgggctgcagcaggctgttcataaggcctgacaaatttgcattcataaagacctgcgcaaaagaagttctccttttggttggccaccctgaacccatgcccttttatcgtgtcaaaccatttcagctccctctcaaagaaatcaagctgatagattcttgaaaagccgtctcggtcctgagccgatgtgacatagatgattccgttgtcttcggacacatccaggaatgattcttcattctcaacaaggccccgcctgatttgtatttcatcatttgtgtgaatgttgaccaaatcgacggcaccgtgattcccttttttggatcccatcgcacataccagccattcgccttcaaatgcgatcatcgaggcggtcatgcggccggtttcttttttgatcataaaagccgattctgatgccaaatcgtatgcccaaacaccgccgtgcacttcatgaatctgcgtcccgatgtaaaggcgctcttcatggaggcacagagagcggataacgggcggatgactcaaaccggaaaacggcttgacgactttccatgagacgccgaaatcgtcggatatgtaaatgcaatgcttcccatgcgcacacacaaagccgtccgttctccccgtgatcgaccaaatcgtggcgtttgtcggaaagcttgagattgaccaggttgccccttggtcagacgatctgataatcgttcctctctcccctgcgccgaataaataatcgccgatataggtgatggaacaaattttgctttttaattgaaagagccttttccagccttgctcaagtgaatagtgaaaaatgccttcccgcttgacggcgacaaagtaaccggaatgctttgccgaagcgacggccgtcgcacctttatgaaacatggatctcagcccgccgtttttgctgttctgcccatcttataaagccttcggcaaattccttgcagcactcggcatcttcatctgtttcaggagcaagctctattttcagtgtctcttgataaaggtcggcgccggttcgttcaagcatggtgtaaaacgtgttgaccgcttcgcaaaatcgggggtatgcataatcgccggatccgaagcatgccgctttctttcctttaaggtcaagcgaagagacctcttcgtaaaacgattccgcttcataaggaagatccccgtccccccatgtgtaggtgccgattaaaagaagatcatattcagccaatgagtcggtatcgacatcatccatttcctgaatggtgacatcaaaaccgtactctcgcaatgtatctttaatgatcatagcgatatcctccgtgttgccggacatgctggcatatgcaatcaatgctttagacaacagaatcacctctataattgataatgattttcattattgtatagatacactttaaatgataatgattatcaatgtcaataaatcgtacaaaaaaaagcagtcccctttttggagtcctgcctttctagtgtttattccattgccgtacattctttcacaacttctacaaacgcctgtacttgcttcagctggaaagccggctcataaccgagcagccacgtatctctgccgattgcttttcctttagcatcaagcaaagggatttggtgaacatggctcccgcttccgtgaagcgtcaccgatggaaggatcgcataaccgattccgtggaaagccatctgtttgcatgtttcaatttggtcgacaataatggtttgtttcggcgatgttttgaacttttggtgccaccagtgctgaatttcctgatagtacgtgctgtcgcttttgaactggatgaacggccgttccgttttggcaatgtcctcaatgtttcggatctctgtatcgacgaggtacaattcgtcccgcatcaagtagtgcttagggcctttccattccgggtttcccctgataatgccaatatgaacatggtcttcgtagaggcttttcagcatttcgctgctccagccggtgacgagggagattttgacgttcggatattgtttaacgtaggttttcagaacgttcggaagccaatgctgcccgataatcgaagcggccgccaatttgagcgtaccgtgtatctcgccctccagctcatctatattctctctcactttttcctgttccaatgttacatcttttgcaaactggataattttttctccggcagacgtgacagtcagccctttttgcgatcttaaaaaaattttcgttccccatgatttctcgatggtctgcagccgctgggataatgccggctgggaaacaaacagacgttcagccgctttccgcatatttaattcttccgccagaacgacaagcatgtgaagctcttgaagctgcatggacattcctcattccaataagtttttcttatcatacatttaatcaaacggctgttttttaatcaagcgggaagtcgggcatcggggaatgtgcggaggattggatggagcgctgcaaataaaaaataggccgctgccgcgcctatttattcaacgtcctcaaatgcttattcagctgttttaatacgacacgccttgtaaaaatgccttcgaaaacctgctcttcattttcgacacatacaaacgcgttgttgatgacgagtccgaatccttttaaaatcggatcatcaatttttaagcgggggatgtccgtcagcatgacttcttcaacatgaatcttatcaagcttctcaaattcgattcgttccaagccgaagattttatccatgatcatattcgttccgattaatccgtgcaaacggaaagaagcatcaagtacagggatcgcggtatatccggttttcgtcaaaacgagaagggcatgttccagattgtttccgacttgaacatgggctactttatcagcatcgatcataaactgacctactgtcgtttcaagaagttcatctgattgcaaactaatcatgatttttcgactccttttcagctttaatccatcaacgcataatttccctatactacaataatataaacaatatcaatatttgtcgaaaactttcctttctcccaaggtcagtttatcattcaatatccttttaggaaacaaaaaagatactctaatgagtatcaattgatataatctgacctaattttcagaccggacacggtcatataaggtaaccagtttcttatatgtcaggctatccacattttttgtaccagtttctatatcattgatctcactgcttagtagctctacggcatactcatggtccaaaagtacgttcagcaacagttttctctcttcttctgaaaagcgttccattcttaaccagccccctaattgatttagctagagtcagaaacaatatgttctctctagtttctatagggctagaatatgaaattgaaaatcaaacgtcaaccgcacatttcgacatctgttcgattttctttcaaacaattattttgtgtaccggtttgcatagcttgaagctgtataggagtcaggtttaattttggcgcagatccccatcgaagtgattcgtcctgtcatttcctgaattaaatcctttgtcattcctttttttccgatatccaaatgaacttcaagggttaaatctgctccctcgtctgtaaacggaagaagcagatccatgatttcattaaaataatcatttaaaagatatgcggcaatctcttggctgtaagctgtttcaagcgatattttctccctgaggctatgtatcggtctgttgacaaccgtgtttttcagacagccccacgctcctttgcctttgcggtgcaaatggatagctgtgataaattttgtgcaattctgatggatctgcgagtctgttccgacggacagcagatagcttgccctcggatcttggcgtatgaacgactttagtctcccgatcacttcaggaaatgtcatttgatcttcagaaagattgtaaaaaagaaaagaatcagccattggaatgccccttttcatttttgatctgcaccgaagatggaacgattcgtctgtctgctatccttttttggtcggtatatttttcaagctgaacccgcagctctcacatctgtaaatcacattctgattggactgggccgtcagaacttgatccatatgctcggttgttttgcaatgcggacaaataacgcttggaaaagctttcatgccatatcctcctattgctgaagcagttcaaagatttcgattgaaatcatatcgatgttgtcaaacggaaatgtggtaggcttatctcctttttgataaactgtcagctcaaacgtttggtttttttcaaaatattttacgctgcaaattttttctccgttcacttcaaaattgcgctgcgtcggttctccggcagcctccgcagtctcttgcaggctctgcagtctcgtgatgatacccattaattgtgacattctaaaaaagactcctttcaaaaaaacaacttcaggatcaacaagtattaattataatacaagttctacaaagcatcataccacaaagtatcagccgatgacatttttcctttttgatcatgaaaaagaaaaaccgctttttcatagtttgagttttcttttttcatgtcatacatgaaaaatatttttttgactgcagaggagtctatttgaaccaccaatttagatttatggagcaaaggattgtcttattcctgcgcgcgcctaatgcccaaaaatcccgcagctatttgaagtgcgggattccatgcaaataaaaaacttggcgggggcagcgccaagttttttaaatcttgatctgatagaggggttggggaacagagaggttcatctctctataattaaatgataatgattatcagtatcattgtcaatgattttctttaaattcttttgctagctgaaaattccggccaatgtccagttaacatcggtggcaaaaagcggagatgcagcctggtctccttcccctttatccgcaaaattcgagcttgtttctttttcatccggttgtttggacattatttcttctccagccggttttgtatcagattggccgatatccgttactttgaagctgccgccggtattcttcagcgtcaccgtctgataatttttttgatatgaaacagggccgtcgttttgatctccaacaaattcatatacggtatagcttccgtctttctcagccacttttgtgtcttcgtcatagctgaagaaagggattgcaacttcaggcgcgtctgtcccgtaaaaaatccaccccgcttgttcaggaaaggcgttcgcctctacatacttcactgccatggcgtgctccatataaggttccaagagggatatcatgtctgttttcgttctttccttttcggtcagctgaaaatggacgtccgatacggattgaagggtctcaaataacgatgctcttgtcggtttttctccggctttggcaaaatccgcgcagaagaatacaagagccgcagccagaagcgcgcacagtaaggatgaccaaacgttcttcatatgatccacccctttttagcatttatattttcacattttcctttatatacgcgaaacaaacctctcgggattcattttttcaaaaagaaaaagcggcgaaaggccgccgcttaaattaatccgtcttgttcgtataaatatgagtaggacaggtcaatgaacagatacaattcttcatccatcggataggaaaacgttctgatcatttcccccgtttcgatatcgctgtacaaatcgctgaaaaacccttttctcatcgttctcatcctcatgatattctcgagaaaataagggcgccagctccaatttttgccgatgtactcaggctgaaatatccatgctccgtcatgcttaaacacgtttttcgtcagctgaataccgtcttcatcgcacatgtaaattctaaagctgcaatctgtcagttcttttccgagattgaagagaaattcatcgtctgactgagccgttttctttagcgatgtgacaagctgatgaacccgtttgtaaaactgctcggagtgatcgtacagaatggttagcttcttcttctcatgcgtgatgaattgatgaaactcggcctgcagccggtcctttaatacatcccgttcgataaatttatccttcggcagctcaagatactgcccctggaaatatcggcccccgtttctccatgcgtattgcagctgaaagctcgcttcaatatcttcataaagcaatgcggctccgatttttctggcaaggagagatatgctgtaaagcacatattcataggaaggcgaaggagaagacagcttgagcggctgaaggtcgatctttaacagatccggagaaagaagagcgattctgtcgagattgctgctttccttaccgatattatcaacagcgactttaattccgtatgtacggtaataggtcagcaaatgatgaagctgttcaatatccccttcaaacttttgctccgtgatttcgataacgaaacggctgagctcgagccctttatcctgatattccatcaacaggtcgaggaacgattcgccgtgatccatcatcagcacatttgcatcttgattgacgaagatgagcaggtcgcgcccgctgtccagaaaatgatcgagcgcctggcggatcaccttgagatcaacctctttcttgtattcttccggaattgtcggatcagaaaaaaacggcccgaggctcttcacttcagtttctaccttgatgcgccccagcacttcatagccgatcaccttttgttcttcagcactgaagatcggctgatagtatggaatgacatcttcaatgttcgttaaaatatcgagtggatccaacatggcatatcacctgcttctaatctttgtctgattataccataccggctcgcacctttgaatttgaaatctaaaacggacggggattcagccattgacctccgtccatcgtcacacactccccgttgacatatcccgcctgctcagaaagcaaaaatgcggcgagtcccgcgatttcttcaggggtgcccagccttttgagcggaacgcttttgattgtcgcgtgcgcggcttcttccgattcaaataatttttcggctccgcccgtcctctcgatcggaccgggcgcaatggcgttgcacctaatcccgtatgcacttccccactcgacggcaagcgtccttgtcagcgacagaacgcctgcttttgccgccgcggagtgaacgacaccggcaccggcgccccatgcatacgtcgcgaccatatttaaaatctggccgcgtttcttttccttgatccagtagcggccggctgcttggctgcaataaaatgtgccgttcagcacgatatcgatgaccgccttccagccgttgaccgatagtttttcagccgggcagataaagttgcctgcggcattgttaaccaaagcgtcgatcgtgccaaaccgtcctgccgcctctgtgatcatctgttccacatcttcaacagaccggacatccatccggcatacggccacctgcccggcaaaagtttcaatttcttctttggccgcttcgagcgtttcttgtgttctgcccgtaatcatcacattccatccttcttcagcctgctttttggcgatcgcttttcccattccgctcgacccgccggtcacgattacaacttttctgtccatatccatcccccttgttatgaatgagtattcattcaattgatagtttatcatataaattaaaaaaaattaacaaaacatgcggactgtcctaaaatggcttttctggatgatataatgtagagaatctattaaaggttggttgattatgaaaaatccgtccagaagacaatttttaaaaggcttcttaggccttgccgcagcagggctctttaccgctgccggcggcttgggctatgcgcgctatctcgaaccgcacatgcttgaaacaaactttattcccattcggcatcggctcattcctaaagggtttgatcagtttcggatcgttcagttcagcgatacccacttaagcgaatactttacagcagacgagctttcaaatgttgtcagccaagtgaacgccctctccccggatcttatcgtattcagcggggatttaatagataaaccgcatcgctaccgggaacacgagcgtgctgtaagcgccttaaaaaagctttcagccccctatggaaagcttgctatattcgggaaccatgatcacggaggctatggaacaaaagtctatcagacgctcatggcatcggccggttttcgggtgctgcgaaacgatttgctgaagcttgaattgatagacggaagcgtaattgagatcgcttcactcgatgatttgatgctcggcagacctgactacgaaggcatcctgtcaaagctgagcaaaaaagccttttcgattttgctcgtccatgagcctgatgccgctttaacggcaaatcaataccccgtcaatctgcaaatatccggacacacccacggcggacaaattcagattcccgtattcggtcctttgattacgcctccgtacggagaaatttatacggaaggaatgtatgaaacagccggaatgaaaatctatgtcaatcgaggaatcggcacgaccaggctgccgctccgctttctgtcaaagcctgaaatcaccgtgttccagcttgaatccatttaaatcttgcccggtcttttggctcaaaacaaaaggcatctgcatacattaagtaaaaacattcccgctccatttcatccaatccccatcaaaaaaacgaaacttcctcagcctctttccgtctatatattagcagcggaaaaggctctcttttcgtttttgaaaaggagatgtgctgattattgctgatgtaccaagtcaaacccggagaaaccctggaaagcatcgccgccgatttcagaacgacccggcaggcgttgctgcaggcgaatcctggcttaaacggcggccaagtgtccgcgggccagtcgattatcattcccggcatcagaaatccggacacaattccataccggattgccgtgtctctcaacggaagaacgctcagattgtatgagcgagacagacttgtaaaaacatatccgattgccgtcggaaaaatcctcacacagacgccgagaggcgaatttgtcatcgtcaaccggcagccaaatccgggcggcccgttcggcgcctactggctgagcctgtcaaaacagcactacggcatccatggaacgaataacccttcgtcaattggcaaagctgtttcaaggggatgtatccgcatgcacaatcgggatgttctggaacttgcttctatcgtacccaacggaacccgagtgtccattacaccttagacgagtacatttccagacaaatgcaatttgaacaatacaacatcttgtattaagatataatgggacctttagggtaaggagcgtatatatggatctttttaaaaatcgtaatttcgtccgactttttttcgcagctttcgcttctcaaatgggaacgacagtcggaaatatggctttcgcctttttcttgctcgaccggttcagcagccagccggcctatacgacaatcgccgagctgatgtattccttgccgacggttttcgtattctttatcgtcggggtggtcgctgaccgttttgaccgcaagaaagtcgcggaaaactgtgattggatcagagcgggactgactgtcgttcttttctttgtattgtatcttcaaattataccgcttgtgtttttagtcctatttatcagaagcgcggttacaaaatttttctacccggccgaagcaagtttggtccaggccattttaagaaaggaccagtatgcaaaggctgcaggactgaaccagatgcttttcagcctgtttctattgttcggcgtaggaattggagcatttatgtacaagacgatcggcttgcatggagcaatcgctcttgattttgtgagctttatcgtctccggctttttaatccgttcctgcgatataccgcttgcagcgcggaagccgaacggaaataaaggctggaaaaacatgaccgtcaaagattcgatgcgcgattttaaggaaggcatcgtttatatattaaaaaataaattgcttgcctctcttgtattcggatattttattttcgggcttgtaagcggcggactttcggttctgccgatgtttaaaatgaagtatgagctgtcccctgacagttatgagtggcatacttccctcttcacaatcgtactgggcatcggacttttgactgggattgccgtcgccgccctgctcgaaaaaaaagtgaagccggcatacatgatgtcagtcccgatttttatcgcgggtgcctttatcatcctgcttggctttacagatcaattgcccgtatactactcggctgcatttcttgccgggatatgcatcgggccgatcaacacagctcttggcggctggattcccaaaatcgtccatccaaggctgatgggaagggtcagcgggtggaccgatccgctgacaatgctggcgcaatcctcagcgcttggcatgatcgctgtcctattcccgggaatcatcgccgatgtggattatatatattacggcttggcgggaattattctgctggcggcgctgtactactttatcgccctgcctaaattaagcgccgagagtgcggaaatcgacgttcaagcggcgctgaagagacaaaaaaatacaaaagcgaaaatgaactctgttttataaagatgaaaacgcgcgattccataaaaaatcgcgcgttttttctatgggatatttgcattttctgttctatttcgtataatttagacataagccttgcatctttaggaggtgatctagaaacgaatggataggagagaaaaaatggacgaccataatcatacgaaagaattaaaaccgacagttgaaaacctttcaaaagcgatttatacagttaaccgccatgcgaaaaccgcgactaatcccaaatacctgtatcttctgaaaaagaaagctttgcaaaagctgcttaatgaaggaaaaggtaaaaaggtaggcctgcatttttcgaaaaatccaagattcagccagcagcagtcagatgtgctgatatctctcggagactacttttttcacatgcctccaacaaaagaagacttcgcaaaccttccacacttaggtacattaaatcattcgtatcggaaccctaaagctcatatgtccttgaatatagcgaaacagcttcttcaaaactacacgggaatcaaagaaaaaccgctcgtcacaaaccggaagcgtccagcctcaaaacccgtcttcaagaagcttggcgaaagctatttttaataaaaaaaaaagcctcctttcgaggctttttttagttcttgaaaatatatttatcaagcttttcgatcagttcattgagctctggcttgctgatttgttcatcggctccgacttgttcccctttatggcgaagatcgtctgtaatcaaagaagagaaaatcaagatcggcagctccgtactcagcgggttatcttttagcagctttgtgagccggtgtccatccatctgcggcatttcaatatccgtgatcatcagatcgactttttcgtgaagagctgtgccgtcttccatcaattgaagcgcgtgctcgtaagcgtcttttccgttttcaaaagacacgatgttgttgtatcccgcttcattcagcttttccaccaatagccgcaagaggagcggagagtcctcgacaatgatcagctttttgtcagtccgtctctgatcgaatttttcatttttcatttgataagggtccatacctgactcagactcaagatcaaaaatgattttttcgtaatctggcaggaaaatcatggtgccgtcgagcttaatgatgccggtaaggtgacggtccatcccttgattcaaagcagtcggcttctcaatttcttcccatgacacccggtgaatctgtgaaaccgctccagtgtgaaagacgattttccgcttgttaaattccgtcacaatgtatttttcttgatgctcgtcatcaccgtgctcaacgccaaagaaagagaataaatcaatgacgggaagaatttccccgcgcaatgtaatcatgccctccatatgcttatgcgaatgaggcactttcgtaatttcaaccggctgaatgatttctctgactttcatgacatttatgccgaaaatgttgagaccaacctcgaacttcacgatttctaattcattggttcccgaacttaataaaatttcctgttggtttgaagacactgatatccctctctatcctactttgtgtttactttttatatcggcgtcttttgttaaaagttgatgctccggctcaagcttttgccttaacattttgatgaatgatcaggccgatcgccgccaataacactaaagatccgaaagccattcggctggccatgttcccgagatccctgaacagcaaagtaatcgatccgtagaggaccggaccgaaaatggaagagattttccccgacaaagcaaacaatccgaaaaattcgcctcttttatgttctggcgtcagctcgataatcagtgtccttgatgcgacccatgtgcctccaagcgaaatgccgaacaagctccccgcaatccaaaacaagagcgttgacgtcgtgcatgctccaatcgtcaaagcggtgatcataatggcggcgacaaggctgaccgcgtgcttggcgccgattcttttcgtcacaaagccgagcagaaatgaaccgatgatgcttgatacagtagaaacaaggtaaagcaaaacgaattgttcggtcgtaaaaccgatgaccgtttttgaataaaccgccatcatggctattgctgtagcaagcgcatcattcaggaaaaagtaggcgatcatgaataagaagaccggcttatatagacgaatgtctttgaatgtctgcacaatttcccagtatccgctgaaaaacgatttcttttctttcggttccggttttcttttctctttcgtgaagagcagatacggaagtgaaaaaaacagaaacaagagagccgacgggatgaatgcgcggtgaaaatcctggttgccgacaagaaggtataccgttaacccggctaaagtgccgatatacccgattgcaattccgaaacctgataagagcgggatttcttcttttgtccccaagtcagccaaaatcgtatcatagaacaccaagcttgaatgatagaaaaactttgcggtcacaaacatgatgacgacaaggatcaaggatagcggaagcccgtatatgtccttctgaaacgaagccccggcaaaaacccccattaaaatggtgcatgaaacacaaatcatcgtaaacaggccgatgtattttttctttctgcccgttcggtcgatcagcactccgaataaaggcgtgaaaatgacaagcagaaagcttgcggctgcgttcgaataggagataaaagtgcttgccacctgattcatgctggcattttcgccgactgcctcctgcaaataaaaaggaaaaaagatcgtcacaatatttgatgaaaaaatggtatttgcaaaatcgtataacgcccaagaaagaatcggcagcgtcaaaaagagcttgattcccgttctttgcgcccgctttacagcttgttcacgttccggctgagtatccatctggattgatgcctccttatttttattcctgccgtgaaacattttcctgaacaagacagcacgcattcaagctgaaagcgtgctgtcttttgcccgttatttttttacgacaatggttcctgccaacatatcatgaagcgcctggcgcctttctgtaaaaaaggccataatgtagccgatcatcaaaatcggagatagaaagcttttggccagaaaccttccggctgcacggccgaatgagattcttccgccttctgccttcgccacctgaacgttcatgattttcttgcctagcgtcccttgccatttggatgattccatcagcgtgtaataaagaaaatacacaataaaagtaatacttccaacgatcgctacggttttgaacatactgatgataaacgtaaagacttcctgatcgctcaaatactcgggatcagtctccatcatgagcatgatatccgaatttcccaacatcaacgtcgctgttaaaacgtacgtgaaaatatatgcgggaatcccgagaatcaatccgtcgagcagggaagctacaaaacgcgcgccgattccggcatactcgctcctttcaggagcagtttcgtgtttgtctaattccaattccaatgtgcttttcctcctaacatcttgacttctatatactactaagactggctgaacattatcaatacgtatcgcatttttttaaagttaaattaatgtacggatcacaagtttttcattgactttgacatttatcgtgttacaatggtcaaggatttttcaggaaaggtgtttatgatgggaacaattgtagcgattaaaaatcatgaaatgaccattttagaagaggtcagccgggccgtttacacagaaatgctcaaggaagcttcagacagtgaagaacaaatatatatttcgtggaaagaagattttgactccgattacggctactaaacggaacataacgtaaggcaatcgtttgattgtcttatttttctatctgccgccgtccgcatgtccgcataccttgcatcgtttcgcatatacttgttacgagtttttataaaattgattgattaaaagatgacaattggtctgatgatggtaaaataagataaaccataacatttttaaggtgatgctaaatggaacatttgcttaatccaaatgtaaaagaaatcgaaatctcagggatccgcaagttctcaaaccttgtatcccagtacgaaaacgtaatctctttaacaatcggccagcctgatttcttcaccccccaccatgtcaaacaggccgccaaaaaagcgatagatgagaatcaaacatcctacactcacaacgccggatatcctgagctgaggcaggctgtacagctttatatgaagaaaaaagccgatttaaattatgaagcggaaagcgagattattgtgacaacaggcgccagccaggctatcgattcggcattccgcacgattttatctccgggcgatgaagtcattcttccggggccggtataccccggctatgagccgatcatcaaaatgtgcggagcgtctccattgatcattgacaccacgtcccacggctttaagctgacagcaaaattgatcgaggaagcgctgacgccgaagacaaaatgtgttgttcttccatatccgtcgaatccgacgggaatgacgctgtccgaagaagagctgaaggacatcgcctcccttttaaaaggccgaaacgtctttgtgctctcagatgaaatatacagcgaactcacttttgacagaccgcaccactcgatcgcaactgtgctaagggaccagacgatcgtcatcggcgggctttccaaatcccacagcatgacgggctggagaatcgggtttttgttcgcaccgaaggaaatcgcaaagcatattttaaaagtccatcaatacaacgtatcttgcgcttcatcgatttctcaaaaagctgctctggaagccgtcaccaacgggtttgatgacgctctgatcatgcgcgagcagtataaaaaacggctggactacgtgtacgacagacttgtgacgatgggcctcgatgtgattaaaccgtcgggagcattctacattttcccgtccatcaaatcgtttggaatgtcttcctttgacttctgcatgtcgcttcttgaagaagaggggcttgcgatcgtgccgggcagctcgttttctgaatacggggaaggctatgtgaggatctcttacgcatattctcctgatacgctaagggaaggtcttgaccggctggagtcctttgttttcaataagaggcaatcgatacagactacgtaaacaacggcttttacgccgttgtttttttattttattttggaaatagaatcttaaatgtcgtgcctttttctgctttgctgtcgacttcgatggttccgttgtgattttcgatgatattgaaggtgaccatcaaaccgaggcctgttcctttttccttcgtcgtcaaaaacggctcgccgatccgcttcaggacatgttcaggtatcccttctccttcgtcctccacctcgacgacgaccgaatcgtcggtttctctgaccgtcaaatgaaccgtcccgccgtttggcatggattcgacggcgtttttgattaggttgataaacacttgctttaattgattttgatcccctttaatgtaaattttgtcgtctgtgaggatcgtattgatcaaaatgccgtttaagttggcctgcgtttctaaaagcgccgtcacttcgcggatcagcctgatcagatcaagcttttctttcaatgcgttttgctgcggctttgccagcatgagaagctcgctcaagatcaattcgattctgcttaactcggaaaagataatattaaaataatgttcattttcttccattgtcggcttcatcagctgcaaaaaccctttgatcgcggtgagcggattgcggatttcatgggcgatcccggctgcaagctgtccggcaatcgacagcttttccgaacggaccatcagctcttcggtctgcttgcgttcagaaatgtcccttaaaatcacctgaaccgccgtttccccgaaaaatgtcgtagggatgcaaaccatttctgtatagatgagccttttttcaaatgtataccacgtctgttttatgatttcagattcggattggcggtctgtgatccgtttcagcctcgctttgacatcttcgtgatcgcatgggtgcaggtgttcgtaaatatctttgccgattaaatcctcatacgtctttgcttcaaacagacgaatgcccgattcattcataaagacccatcttcctttatgaatcacggctatcgtatcgattgagttttgaatcaagagctgatatcgctccctgcttttttgcaaaatggtctgaaatttttttctcgatgaaatgtcaatgagaagaagcagctccgctttctggttttgataaatggtcggcgccgccttgacttcgaggtgaatctgcgtgccgtcgagcttatgccacgtttgctcgatcattccgacatcaagtccctgctgcatccgcttaatgcggtttttgacgatgtcatggtactctttctcgataaaatcgtaggaatactttccgataatttgccgtttatgctcggctccgagcaggttgaccatggcgtcatttacgtagactatttccccttgaacgctgatgcacagagggtttggcaagccttcgatcatggcttcgaattcctcttttgccggcagcctggaggcttcttccggagcgtcttcctcttttatggagctgcttttcttagagggacggtcttcaaacactttcattttgagtacaatttcgcgttctttttctccaacatgggtcgtcacgaaatcgatcgatgcttcgatccagatcatcgtgtagtcttttttcacaaatctgaaggtgcagggcagcaaatgatgctcattgtaaaaatagctttctaccagaaaaagatcgtcttcgtgtaaatagtccttcaaatacgtaccgatcagttcattctgctcgtagcttaagagctctttgcaatttgcagatatgtatataaaacggccgttagctgacaggactgcctgtaaattcatatgaggcttatattgctcaaaacgttttgttttttgttccatcatatccctcctttataccctattcatgaccagcattcattaaaactattttgcttaaaaggattcgctaaaatgcgagaaatctccttcaaaacttctagcattcgtcaaattttgataacaaaaaaagaacccggaaaaaatccgtgttcttttttgtctaatctttgctgtattttttttgcagatcgacataggctttgacgattttggcggcgatgtttttgttcatcttcgttttgtcgtcgacattcgggacgacaacgctgaaggcgacctgcggattttccgacgggtaatagccggcaaaggtgatattgtaagtcctagtcccccaccagtttcggtttgtgccgtagtattgcgtctgcgccgttccggttttgcctgatacgtcaagcgaaccgaatgcgccggctgcagttcccgtctgggttactcgtttaaatccttgcttgacgatggcgatgtcgctttgagaattgttgatacgattcagcacattggcagagcgctcttcaatgaccggaccgagtttttcgctttctggctggtgaatgcttttcacgactctcggctgcaacctgtatccgccgttggcgatcgttgaaacatattgggcgagctgcaaaggcgtgtacgtgtcaaactggccgatcgcttcatcgaggaggagacccccgactatttttgggtttgtctgcatcccggccgactcctgcggcaagtcgatgcctgtttttaccccaaggccaaattgattgaagtaatacctcattttctttaagtcctctaggttcgccggaagcgggccgttcggtacatacgtaattcctgccattctcattgccacatagaacatataaacgtttgaacttttttccagcgctctaacttcattagcccaaccgatagtgtttcctctgtaggaaccttttttaactccccctgcgaagctcagctcttggtctaaataactctgcccatgcggcatgccgtcctgatagccggcaagcacggtcgcgcctttgaccgccgatcccatttcgtactgggttgtaaacgcgccgattgcatagtcggtgattttgccgtcgacgatccgctttccggccatggacagaatgtctccgttattcgggtccatcatgacgacgaacgctctgtccagcatgtagtttgagccgcggaatttattaagctcctcttcgatagcctcttcgactttcttttggagctccatgtcgaacgtcagctgcagatcgtagccgcgtcttccttcatcaaccgtttcctggctgataacctttcctgaacggttttcggtatattggactttcgcttttttcggatttaaatattcttcatattgatactcgagatagctttttcccactctgtcattccgggcatatccccttgtcaggtaaaagtcttcccggtccttgataagcccttgttcaggcgttgtgacgcctccgaaaatggagtagagcgttttttcataaggatatttcctggtccagtccatgatgacgtcgacgccgggcagttcctcaagatgctcggaaacgcgtgagacttcctcatacgtcaaatcgttggccggcatctgtttagaagccttctcatcaaggagctgcgcatcgtttttccccgcggttttcgggctcatcgccttgacgatttgcggctcatacgcatagccgccagaaaatcttctgaaaatcgctgcgactttaagctcatctttgtccttttccagcgctttgatctcttccgccggaacgcggtccacctgaagcttgtatgtttgatcagacttgagggttttctcgctgtctttcagaagtgcagcagcttttttcgggtgtctggcaagccagtaatctttcagatctctctctttcagaaacgaagtatcgatatcgatcaattctgcgagttttttggctgtgctgattttttcctccgtttttgtgctagtcatcatcgtatatgtgatcgcgggaacgctttggttgtcgacaaccacccgcccgtatctgtcatacattttaccccgcggtgccgggtatgacgcaattttcgcctcggttttcgaagcttcctgctcatacgcctctccattgacgatttgcacgaggcccagcttgacaatcagcgcagcgaacaaagtgaacaccgcaaagaagtacaggttgatccgccataaacgcgaacgcctgctctttttgatttcagccggatcatgttgagattctgtcactgaaactctctctcctctcacaatattcaattttacattaattaactgagatatattgtaacacttttgtaatggttgttacaatctaaagttttcaaaaaagctgtcaatctctttttatattaaaatttaactaacaaatttaaattttaccacgtttatgacaagacgtgtaaaagaacgatctggttgcatattggcagcaaagggtttttctttttttatgtcaaaattaacaataataccttgtcaaagggaatatatggatctattatttcaaaaaagccatgttatgattctagtgtacgaaacaacaactactacaacatttaggaggattactgtttatgaaaaaagcttttcttttatcagcagcagctgcagcaacgctcttcacattcagcggcgttcagcacgcagacgctaaagagcagcagcaagtacaagtcaaaaccgttcattccataaatgtaactgatctcgcgggcaaactgaatatccaaaacatgaaccagctttctaaagctgaccaagaaaaaattcagtccctgcttcattcttatatgaaacaagcaactcaacagcctaaagcttctgcaccgaaggcttctgctcctaaagcttcaaagcctgcggcttcaaaagagcagacttcacagcaaaagcaaaatacagcgcctgcatcttcttctgtaagcgcgtatgaaaaagaagttgttgaactgacgaatgcagaaagaaagaaacaagggctaaaacctcttacattggatgaaaagctgagcaaggttgcccgcacgaaatctcaagatatgaaagataacaactattttgatcacaacagcccgacttacggttctccatttgacatgatgaagaaattcggcatcacataccgcactgccggagaaaacatcgcaaaaggccaaaaaacgcctcaagaagtcgtcaaagcttggatgaacagtgaaggccacagaaaaaacattatgaatcctaacttcacgcatatcggtgtcggatatgtgaaggacggcaactactggactcagcagttcatcggaaaataagaaccagcaaaaaaccacttgcatgcagcaagtggtttttttcgttatttgtattctgtccaaagcttgtacagactttgggtgccgctgttttcttcgcctttttcaacaagggtgtcgtaaaggcttttcgcaagctcgagccccggcattttctcgcccatcagctccgcctcttcaagcgcgatgcccatgtctttaacaaagtgtttgacgtaaaaacccggttcaaagtcgcctttcagcattctaggcgctagatttgagagcgaccagcttcccgcagcgccggtcgtaatgcttttcagcacgttgtcgggatcgagtccggatttttcggcgtaggccatcgcttctgcgacgccgatcatccctgcggcaatcgcaatctggttgcacattttcgtatgctggccgcttccggccggcccctgatactggatgttttcacccatgatcgaaaagagcgggtagcattcatcataagctttccgttctcctccgaccatgatagcgagcgtgccgttcctcgcgccgacgtccccgcctgaaaccggagcatccaaagcgtaaagtcctttctcttttgcggcagtctcgatttgtttggcaagcgaaggtttggaagtcgtcatatcgataaggtaggaaccttttttggcattttcaataatgccttcgcttccaaagtaaacctcttcaacgtcttttgggtagccgaccattgtgatgatcacatcagacgactgcgccagtgctttgacggatgatttccattccgcccctttttccacgaggctgtccgctttgtgtttcgttctcgtataggcgctgacgggatagcccgcggctaaaatgtgcgaggccatgctgtttcccattacaccgagtccgataaatccgaccgtttttttcatggtctcatcccccttaaattgcttttaccattccgccgtcgatcagcagcgtttgtccagtcatatatgtattgcactctgataaaagaaagcttgcatactgtgcaaagtcgtcaggttttccgtaggagccgagcggaatttctttctcatagctttctttcacctgctgctcggaaaggcctgttttctcggctttcagccgatcaagctctgccacgcggtccgtcgcgattcttccgggggcgagcgtgttgatcaaaatgcggtgttcggccaactcttcggcaatcgattttgtcagaccgacgattcccattcgaaacgtgttggaaagcagcaagcccggaatcggctgtttgactgatgatgaagcgatattaacgatgcgtcccccatcctttttgagatatggaaaagcttcgcggattaaacggacatagctgagcagatgcaattcaaatgatgaggtccagtcatcgtctgtcagatcaagcaggctgccgcccttcggtcctccgacattgttgacaagcatatcgatcgttccaaatgtgtcagcggtcttttgaacgagcgctttgatcccgtcggcgtctgcaagatcgcatacttgataagagacggtgccgccgccgagtccgttcagctcttccgcggcttttttcaagtccgcttcgtgtctcccggacagcatgacatttgccccttctttcgcaatggctttggcgatcgcattgccaagtcctttgctgcttgcagccacaagcgctgttttgccattcatctttaagtccacaatgatcactcccttccttcttatagtgtaacacgtatattctgaaaattgggattgtgaatgttgaaaaaggagaagtccctctttcaacaagagggacctctttattacacgttaaacttattgatcgcatttaataattcttggttggcctcgctcagcgcttcagccgattttgcgatgctttccagcgctgtcagctgctcgttggccgaagcgctgacctcttccgcagccgcggcagactgctgggaaatggctgaaatgctctgaatcgaatcggacattttttgctgctctccgctcatatccgagatttcagaataaatgtggtcaattgagttgacgagcgcctgcatttcagcagtaattttgctgagcgcttcacctgtttcgtgaatcattccattttgcacttcattcatcttgcttgcttctgtcatcgctgaaacggcttctttcgtttccatctgaatctgtttgaccgtttcactgatgtgctgtgaagaaaccgccgattgttcagcaagctttctcacctcttctgcaactaccgcaaaaccgcgtccgctttctccggcacgggccgcttcaatgctggcgttcagagcaagcaggtttgtctgatcagagatcgccgagatggctgtaacaacgtcttcaatgtttttcgttttttcttcaagctggaatagcatatgttccactttctttgtctccgagtttgcttcatttgactttgcaagcagctgcccgagggcatcgattcctgtatagcttgcttcttctgatgttctcgaaagtttcttgatgctgtcggcatgatgttcgatttctttaattttgacagacagccgttcggattgttcattgacattttcgacctcagccgcctgttcagtcgcgcctgtcgccacttcttcgattgctttggcgatttcatcgctcgcagaaaccgtctcttctgaaacagcgcttaattgatcggtcgtatccgatacttttccggacgatgatctgacttgcacaatcatttctttcatatgttcgaccatcttgttaaagtcttttgtcaatataccgatttcatcttttgaggcagctgctgtttggaccgtcaaatcgccgccagcgactgcttttgttttggcaatcagctgcttaatcgggcctgtgatcgttttggcaaggaaatagcttaaaatgatcgccgctgccagagcaatgattgaaacgataatgaccattttgttcatttcctgcgcgacccacatcagcttcgccgtgtcgaactgcgtaccgactttccagcccgtaccgccgacagtctgataagcgatcacagtatctttgcctactttgattccgtcttttgatgacgggatgtcccgatatgttttatcattcgatatatcgtcgccctgttttgacgggtgggcgagcattgtcccgttttggtccaaaataaatgcgtagccgtcataaggcatcttttgattttcgataattttgttcaatgaattcaatgacaagtctatactgacaacgccttcaactttattattgacgacgatggcttttgccgcagtaactgtcatatctccggaaaccgcatctttgtaaggttccgtccaaacgactttgtcgggtgtttttgcagctgacgtataccatggcctttcagccggattataatcatcatcaaaggtcgttttcggaaatgtaaacatttccttcttttttgtgccgatataagctaaattgacatactcatttttttcttttaattgttttaattcatcattgacgatttttataattttattatccccgtcttttaagaatgagtgagccatttctccatcacttatacgattcaaagaaatctcgtagtgttctaattgaagctcaatatttcttttaattgaaccgaggaggctggacgttgattcttttgcctcatcttcaagcatcgatttcaacaaatgtgttgtcgagaactgtaggacgataaccgtcaaaaccagcaggacggcaacaaatccggcaattttgacatgcagttttttaaacaaatgaaaccctcctttacatgcaccttcatattctttttatcggcaaaaatttcgcaaaattaagatagcctgttaaaataacggtataatggaggaaatagcaaaaggagtgattggcgatctataaacagttttacgtcgataacggcacttcttatcagcaggtggacatccgcaattacagcaaaaaagatattcccggtttgattgctctccaaagagaatgctttccgcctccgtttccggaagaccttctgtggaatgaagagcagctccattcccatattgaacgatttcccgatggagcgctttgcgcagtttccgaaggccgcatcatcggttcgatgacagcgctcatggctgattttgatccgcatcatccgcaccacagctgggatgaagtgacggacaacgggtatatcggcacacatcaaaacgatggaaactccctttatgtcgtcgatatttccgtgtcccccgactatcgaaaactcggcatcggaatgcggctgatgcaatccatgtatgaactgacggtctttaaagggctcaagcgtctcattggcggcggacggattccccattatcacaagtcggctgaagaaatgacgcccgaacagtatgttcaagctgtattggacggggaaaagcgcgatccagtgctctcgttcctgcttcattgcggacgctctccagtttgtgtgattcccggctacattgaagatgaggaatcgcttgattatgcggtgttaatggagtggaaaaatccttttttaacataatgttttcaaaacaaaaaacagagctttatcaactaaagctctgttatgtgaaatattcgatttttgcttcgggaaaatagttgtcgatatacgattcaagggcgctgcgaagctctgcttcttcatccttctgataaatgtatttgccaatcccgtatctgccccatttatagcgccgtttttcttcatccagttcgagctttgtctttggatagtttttttcaatgactctctttgccggcttcgtgaatctatgctggatcatttcaaaggtgatgtcgcgcctcgcatgctgcggcagcgcacgatcgagcttttccagcagaactctgtagccttcctgccagccgtcatgaatataaatcggagcgatgataaaaccgagcggatagcccgcttccgctactttcacggcggcttcgatccgtttatccaacggggatgtgccgggttcaaagcttttaatgacatattcggcattcacgctgaagcggaagcgcgtttttccgttgtgcttggcatcgagcaaatggtcgacatgatgaaattttgtcacgaaacgcagcttaccatggtcggtttgaccgaaatgctcaatggcgcgttttaacgtatgtgtcaaatggtcaattccgacgatatcggatgtgcaggaagcttcaaaccgcgtatcttcgggagccctttcttttatatattgatccgcctgctcaagtatttcctccacattgacgtacgttctgatatacggcttgctgcccattgtcgtttgcaggtagcagtaatgacagtgacccatacaccctgttgcaaacgggatcgcgtattctgcggacggttttgacgaatcgaacttcaatgtttttctgacgccgatcaccaaagtggatttcgcatttctgtatttttgcaggtggccttcccccgggatattcctcacctggttgtgtgaagttgtttccctgatctcaagtcccatgtttgaaaatttatccctcagctcttttccaagcggatattccagggctctcggttcaatatagacgagttggggaacaaacggttttaccattggaaacagacacatcctttgcatatttccattactttttgcatttagaggatgtgatataccggtaatgtcttcatatcccgtcaaataattcacggtaaagccgttccgcctcttcatatgaagaaaaaacggcatcatcttcggcaaaggcgtgatatgtatcatacataaacaatgccagttcgccttcgtgaagcggatgatcaacgacttcagcttcctttatatgcgccacattcgctgcatgcggattccggtaaatgacatacacctcatctcccggtttgaatggctgcctaggcatatcagaatccccctttctaacaattggtcacatgtattatctccgccgcagccgggatcattcagataaacaaaaaacccggacgggcattggtgatgccggtccggattttcaattgcttatgccaggttgaaggtttcttttacgaattgtacaacctcttctgttgtgctcatagacagaatttgctctttgaacgattctgtctcttttttagaaagcttgctgatttgcgttcttgccggcaggattgacgtcgcactcattgagaactcgtccaatccaagacccagcaggatcgggatcgcaatttcatctcccgccatttcgccgcacatgccgacccattttccttctttatgagccgcttcaatgacaagcgtgatcaggcggagaatcgcaggattgtatggctggtaaagataagatacccgctcattcatccggtcagcagccatcgtgtattgaatcaggtcattcgttccgatgctgaagaaatcgacttctttagcaaattgatcagcgatgaccgctgttgaagggatttcaaccatcataccgacttcaatgtcgtcggaaacttgttggccttcagctttcagcttttctttttcttctaaaagaatcgctttcgctgctttaaattcgtttacagtcgcgatcatagggaacataatttttaagtttccatatgtacttgcccgaagcagcgcacgaagctgcgttctgaaaatctcttgctcatcaaggcaaagacggatcgctctgtatcctaagaaaggattcatttcttttggcagttctaaatatggaagctctttgtctccgccgatatcaagagtacgaacgacaacggatttgccttccatacgctcaagaacggttttataggcatcaaattgctcctcttctgtcggaagctggtctctgcccatgtaaaggaactcagttcggtaaaggccgactgcttctcctccattttccaaaacgccttttacatcatcaggtgtaccgatattagcggcaagttccacgtgatggccgtcgctcgttacagtcggttcgttgacaagctttgcccattcggctttttgcgccaggaaggcttgatgcttttcttcgtattcgctgattgtttcctgggaaggatcaacgatgacatcgccattgatgccgtcaacgataactgttacgccgttttggatgcctttcgttgccgcttttgtgccgacaacggccggaatttcaagcgagcgcgccatgatggcagagtgggacgtccgtccgccgatatctgttgtaaacccttttacaaagttgcggtttaattgcgctgtatcagacggtgtcaagtcttcggccacgatgatgacttcttcggaaatcaggctcggattcggaatctcaacgccgagaagatgccctgtgacacgcttggtgacatcgcggatgtccgcggcgcgttctttcatatattcattgtccatcgactcgaacatggtgacgaacatgtcggccgtttcttttaaagcgaattccgcattgacagaatcagatttgattttgtctttaatcgggtttaacagttcaggatcgcttaatactaacaaatgtgcagaaaagatttccgctttatcttcgccaagctctttcaaagcatggtttttaatggtttcaagctctttcttagaacgctcgatggcgtcttcaaaacgatttacttccgcatcagaatcagagatgtttttcttttcaaccgttagatcaggctcctcaagccgatatgcttttgcaatcgcaataccggctgaagcgcctattccttttaattcaagcattattcgcctaaaccttcgcttttcattgtttcttcaagtgcggaaagagcatcattttcatcagcgccggaagcagaaatcgtgatttcagcacctttggcaatacctagtgacataacgcccataatagatttaaggtttactgtttttccgttatattccaaattaatatctgcatcatatttgcttgctgtttgtacaagaacagtcgctggacgagcgtggattccagaatctgcagttactttaaacgttttttgtgccattttttatcaatctccttttaatttaaagctttgagtacattcacaatattatatcatacagccgtacatgtcatctgacaagtacggccattttgtgaatttatttttcgatgcggacgatgtcgtcctgtgtcaggctgacattgccttctgcctgcaagctcacgctttctccttcttgaaggttcgtgaacacgatcggcgtcatcagggaaggtacattgtccttcactttttcaatgtcgacttcaagcagtttctggccaggctcaaccctgtcaccttcagaaacaaatgaagtgaagccttctcctttcagactgactgtgtcgattccaaagtggatcagaatttctctgccgccgtcagactgcagaccgatcgcatgctttgtcgggaacacgttcagcactttccctcttacaggtgacacaactgtgccttctgcaggaagaatcgcaaatccgtcacccatcatttttccggagaatacttggtccggaacatctgcaatcggatgaagttcacccgcaagcggtgaaacgaatacttcttcacctgattcgttttgaagaggctcaaccatagcttcttcgatttgctgctccacttcctcggcagcgttcggcgctttttcaggacgaggcgtccggcctgacataatgtcttgcatttgtgattttaaattgtcggatcttggtccgaatatcgcttggatgttattgccgacttccagcacgccggaagcgccgagttttttcaagcgctctttgtcaactttcttctgatcgttgactgttacgcgaagtcttgtgatacaagcgtcaaggtgcttgatattttcctggtcacccatcgcttcaagaatttgataaggaagatctcctgctgcttctttgccttcatcagcgggttctgcagctgcatcttcgcgtccaggcgttttcaagttgaacttgcggatggcaaatctgaatccgaagtagtagatgacagccaggactaaaccgacaggaatgacaagccaccaagctgtacggttcggcagaattccgaacaggaagtagtcgatcaaaccgccggagaacgtcatcccgatcttaacattcaagatgtccatcatcatgaatgacaggccggcaaacacacagtgaatcgcaaacagaatcggtgcgacgaacaggaatgagaattcgatcggctcagtgatccctgttaagaatgatgttaaggctgctgaccccataataccggcaacaagctttttgttctgcggttttgcttcatgataaatggcaagcgctgccgcaggaagaccgaacatcatgaacggatacttaccggtcataaatgtacccgctgtcaattcgacgccgtctttgatttgcgccatgaaaattctttggtcaccgcggacaatttctcccgcctggttcgtatagctgaagaactcataccagaacggcgagtagaaaatatggtgcagaccgaacggaatcagagcccgctcaatcattccgaagatgagagctgcgaccgcttcattggctgcaagcaggttcgttgaaaagctgttcagtgcgccttgaattggcggccagataaacagcataacaagtcccagcagcaatgcacaaatagatgtaataatcggaacaaagcgctttccggcaaagaatcctaaatattgcggaagctcgattgtgtagaatcgattgtacatggctgcggccaggacaccgacaataatacccccgaatactcccgttgccaatgtcggtatcccgagcattgtcgtgtattccggatggttttgagtaaagaactgtgctctttcaactgcatcgcttggaattgaaccgttttgaaggagcactgcactcatcgtgacattcataacaagatatccgataatagcagcgattccggcaacgccgtcgccgttagccaaaccgatggcaaccccgacagcgaaaaggagcgccaagttggtgaacacaacgtcacctgaactttccatcactttcgcaacaagctgaacggtgctgttcgttaagaatggtgcgacttttgtcatctgcggattttgcatggcattaccaagcgcgagcagaatccctgcagccggcaggatggcaacaggaagcatcagcgctcgtccaattttttgcagaacgccaaatagcgatttaaacattttttaaccccctctaagaatagtttgaccttacagcaaaaattcatgacaacttcgttcaaaagactgctttttcatctaaataaaccgtttacatttcgcctttagaacgacaaaaaaggcatggtgaaagcgggtacactaagaaacaaaagacagcgtcttcatttctccccttttttcactcatgcctgatcgaatcagtaacacgttataaaggcgttatgaaattttattagtcaaacggtacaaatgcaatgtcaaataaacggcttctgcctcatgaaccggtttcttgagcgcttgctgcaagatcttgatcatcttccaagcagtattgtaacacagcggatattccgttttcaacaacaacattaatttttccggttcctgaatcggctcgtcccgttttatcctgtcaatcgtaaagcgcaagtgcctgatcagccgcaaatagttcacgctttccctgttgacttgcatctggaatgaatcttcgatgacctggacaagcctggagatcagttgtgaatgctgattgacttcagaaagcgggcggtttgtcatcgcactgtggatatgaagcgcgatgaacccgatttcaccttcaggcagctgaatgtcggatttttcattaatcatatcgacggcttccttggcgacttcgtattccttcggataaagcgattccgtctcaagcaaaaacggatttttcatatcaaatcccttttctagacgcttaactgcaaatgcgatatggtccgtcagggcgacatgaatgtgttcgttcagcggctggccgattttttgcgcgatatggtagatgacatcattggcgatatcaaccattttttcatcgacataagtgaggagcttcttatactgcgattgttccttatcattttccaggataaacattttttcgtagttctcatgttcgataagatctccgcgctttttaccaaaaccgattcctttgccaatcaagacaacttctctgtaatcatcatggagagcgattaaaacgttgttgttgagtaccttttcaacggtaaaggatctgttcacgatcctcagctcctttttgtcatcaatctctcatatcgtacaaaactcatgaaagcgcgtcaatttattttgacgtttttgatgaaaaatgtcgaattttgatcactgtctggaaaaagattgatgttttgattacacagtcgcccttttgatcagcttgtaaggaacagtcagtttttccggcccggcgccgccgattcttttttgcagaaggcgaaacgcgcgcttccccatttcctttatattgatttcaattgttgaaatgccgagcacttcgctgatcggctggttgtcacagcttaaaatagcgaggcttccgggaatatccacttgatgccgctgcgcttcaagaaaaataccggctgatacttggtcgtttgcgacaaaaacagccgtcggcttctcctccatccctttccattcggagaacagtttttgcccgtcggtaattgtcagcgaccgctcaaatacccactcttcccggtaaggctccccgatcgcggccaaagcttccttgtatgccttgaggcgaaaatggctgttcatgccgtttttccttgccaaaccaatcgcgatttttgtgtgccctttttcaattaaaaaatccaatccaagtctgaatgcttctttatgcggaatgctgaccgttgcaaagtgctgctcgcctgagtcctggcacaggatgaacgggccggtttcacgccagtccaaaagcgcttcatcggacatcgcttttgaacagaaaatcaggccgtccacctgtctttgtttcagctgctccaatgcaaaaatttctttttccaattgataatttgtttggtaaagcgaaaagtgaacgccttccttcgcagcttcttcagcgattccttccagcagctcgccgaaataaggaaggctgatggtcggcagcacaacgcctatcatgttggaaaagcctttggataaatgaacggcatgcatattccttgcatattcgaggcgttcaatcgtctcaagaactttttgacgcttttcttctttgacatacgggtggccgttgagaaccctcgaaacagtcgtgatggaaacccctgccgcttcagctatttccctgatatttgccattcgtttcccttctttcattcaaatcttttcgcacatccggatcatttcatcataaagaaattatatcgctttgagccgtagattttgatccttttggccattttttcgggattctattgatatgaagaaaacagcgaagaagatttcggaggaggtacaaggcggcgaaaaaaatcggctgatatgaaaatatttcacaatcagccggatactcgaaatattttttatctaaaccatgcttttcctaggttattcgtgaaattgtgatcattgaaaggaacgtttgcgcttccgaaatccgttgtgttcaatgcgtttcttgcggcaggcgtcaaatcttcccacccgatgagaggctgggtgccgccctttgcactgtccacatataggctgtggttgatcggcggttgaggagcatcatagcggatcttcggatgatcgccttccataatattgttgtttggcgctgttttttgaaatttaccgtgttgagaataagcgatggaaagcacttttggattttgatttgccggattgtcgatccatacgacgataccttcccaatcatgtcgatggccgaatgcttttaaaggcagaggtgaatctttaggaaaataccatgcatacataatcgcccaaactccattataccatgcggatcgtgagtacacttgtcccacgcttttgctgcagtggccttcgggcgctccggtaggctccagacctccgcttgtgttgccttgtgcgtcaactgccggaaaaggcacgcagccgctcgcaaccttcaaataaggctgaaaacgtttggccgctttttgggaaaccgtcacaggggtcacttcgctgaagccttgcactttgtcatgatcaatgactttcgcctcagctgccggtactacactgacaaaagcaaacatcgacataaacagtacaaaccctaattttttcactctttctagcttcctttcagaggtaatggatggcttcaaatcattagaaaaatccttaatgcttatttgttttatgggtgattccgcaatcgttgcggagactgaaatatctggatgcgagatgaaaagattttgtctaaaacagtaatttatcagtgtttttcccgtgtaatcccccctttcttctgagctaagtatacaaatttttcacatgagaataatgatgcaatccgattatcttttgatcaaactaaatcaccaaaacaaaagcaaaaaggcgtcatagattcattcatcaaacgatcatcacaggacttttttggcagcatgcagccccaataaactcaagcgatggtcaaaatattccagaaccctttggcatcagaagtttcttttattgatttagggcttgatatggaaagcgtttcataatttagaatgaagacagcaccggtgctgaacacgtttacattccagaaaggagaaggaaaatgggcatcttcattctgatcctattatgtatcgttatcgtgctgtcttcaaaagcagcgatgaaacccctcaaagaaaaacacgaaatcaaaccattccgttcctttgacgatttcttcatttcaaaggattgacggtgagatgaaaagattcacttccgtaataaaatagaacccgcgcacggcgggttccattttttatgaaatgacagtcagctcttttggatactttgtcagcgcttctgctccatcggctgtaacaagtacatcatcctcgatgcgaacgcctccgatttccggcacatagatgccgggttcaatcgtgtataccatgccttgtttcaaaagttcgtcattgttatggctcatggacgggtattcatgaggcgaaatcccgagcccgtgccctaggcggtgcggaaagtaatcgccgtagcccgctttttcgatgatgccgcgcgcttttaaatcaagatcgccgattctcacaccgggtttgctcatcttaagcgcctccgtttcggcttgaagcaccgtattatatatttctttttgtttttcgctcacattttgatacacgagcgtccttgtaatatcagagcagtatccgtcaatgattacacctaaatcaaagaggacgaaatcgcccggcttgagcgtccggctgccggggtttccgtgcggctgtcccgatttttctccaaaaaggaccattgtggaaaacgacatcccctggactccttttttcttcagctcatactcgattttagcgacgacatcgatttccgctatcccctcttttaatgcggcggctcctgcttcgaccccgtaatcggcaagcttggccgcttcgcggaggatgctgatttctttttcgtctttgatgacgcggatttggttcagcctttcttctgcagagacaagctccgcaccgtttgtgaccgcctgcagcatttcggcgcgcgaaagagcaagcgtttctttttcaaccgccacttttaaacattggccgtttcgcttttgaagcgctgaggatatgagttcccaagggttttgatgatccccgtatccgatgatctcatacgcccagccggctgctctcgcctgaccggcctccatttgcggacaaacaaaaaacggctcttcatcttgaaaaataaaaacgcccatcagccgttcatgcggttctgtataaaagccggtaagataaaatacgttttcttttgaatgaataaaagccgaagatatgtttttttctttcagccaggaagagatttgttcaattctttccatgctctgttcactccttgagacagtttccgtaccatacatgtaaaatgtaaaagcatcacatccattgtatcagtttttcccgtctcttgctcaccgcttatgtattgtgggggtgccgcccgcttctattattgccgcctcttcctcaaactgccctctgatgtgaaaaacggctgccgttagcatgcagccgtttctttgcttaggatttcagcagtctgagaccgtttaaaatcacaagcagcgtgctgccttcatgcccgatgacaccgagcggcagatcaagaatttgaagaaagttgctgcagattaaaagacagatcacagcaagcgagaaaatgacgttttgtttaatgatcgtattcattttccgggagagccgaatcattttggtcagtcctgtcaattcgtttttcattaaaacgacgtcagccgtttccagtgcgacatctgttcctccccccattgcgatccccacatcagcggcggctagggccggtgcatcattgattccgtctcccaccataacgattgttccgtatgtttttttcagctttttcgcttcctctacttttctgtcaggaaggcattctgaaacgacgattttcaagcccgcttctcgtgcgatggccgctgcggtttcaggctggtcccctgtcagcatcgccgtctgaacgccaagcgcgttcagctcttcgaccaccgcttttgcttccggtctgatttggtcttttaatgcaaaacaccccgcgattttttcgccttttttcatgaacacaattgtttttccctgcttggcaagctcctgaacagccgccgtgagaaattgcccggctgcctcttccccgacaaatccggctttgccgatcagccatgtctctccattgtatcgagcctgaacgccaaaccctgacgtctcctcaatcgacacattcgcggccggcttgatgccttttgcttctgcatactcgacaatcgctttggcaagcggatggcctgactgcttctcaatcgcagcagcagcctccaagcattcgcgctcctcgatatctgcagctaaaagcatatcctccacgccgggctttccgttcgtaatcgttcccgttttatccaatgcaacgattttgctgttgccaagcttttcaagaaagacgctgcctttgacaagcaggccgtttcttgcgccatttgatatcagcgacagcgcggcaggcatgattgaagcgacaagggcgcacggcgaagcgacgaccatgaacaccatcgctctgtaaaatgtctcgctccagctccagccaagcaaaaaatgcggcagaaagagcagcagtccgacagcaagcaaaacccctttaacgtaaatattttcaaatcgctcaatgaacgcctgcgacggtgaaacgctgttttgcgcagactcaacgagccgaatgatctttttgaacaacgaatcttcatttgcctttgtgacacggaccgtgagcgatccgctcaaattgaccgtacccgcaaaaaccgcgtctccgagtgttttttcggctgggatggattcgcccgttagagccgattcgtcgatactcgtttttccggtttcgatttctccgtctgccgcaatgcgttctccaggcttcacaagaatgaggtcgcccgcctgaagatcggctgccgccacggttcttgttccttctttttcaagcaaaacggcttcctccggctccaatttcatcagtgaagtcaaatcgcgtttgcttttatttaatgtatacgtttcaagcgctccgctgagagaaaagataaaaattaacacggccccttcagcccagtagccgatcagcgcagacccgaccgccgcaaaaatcatcaagagttcaacattcagcgttttttccgacagcgtttcttgtataccttctttcgctttagcaaagccgccgatacaaaaagctaaaataaacagaacaacggacaatgtttcattgccggacaacagccagcctgcaagaatcaacaaacccgacaaaagcgcagctatcaattccccgtgctgcctccaattttcaaattgcaacgtgtgacggttttgctgcgattgcttcccgatctctaattgcatctccaatatcctccctaattgagaatgtaattcatcgtcaatttccttcttaaaaaacaaattgccgcctcatcggcagcataaacattaagtattttatttatataaagggtatgactgctacttgtccattggacacacccttttctatttctcattatagcacgacatcctacgttttcaaataataattattataatttctttatgatattaattatcatttacattttaaaaaaagctgaactcccggctcagcttttccctgcccattccttcatctgttctacagtaatggggccgacaaacgttttctccagctctcctttttcattaaagaaaaaagtcgtaggaattgtcatgactttatatgctttcatcatctcaccctttttgtcaaaaacgatcggaaatgtcagcttgtttgctttaataaactgttttaccttctgttcgttcttttcggcattcagtaaattaacggtcacgagcttgacgccggattgcttgctttcatagtaggattggaatcgcggaagctcttcacggcatggcgggcaccaggtcgtccaaaaatgaacgatcgtcttctggccttcggcgggaatgacgacgcgctgaccttcgaccgtgttcatctgcatgactgccggcgaagcttgttttgcagatgcctgcggctgaaatacgaataacccggtaaaaaacagcaggatgagcgggtaaatgagactgattcttcgcatgggaactccccttcttttttaatattagcttccccgcaaaagctaaaactatgaagaggatccatcagcggctttcaattctcggagatcgggatttgtttgtcaaaaaaagcgtgacgcccagctccttgcaaatcgtcacataatgcagcgccgtcagcaaaatcataccggtattcatcgcaagaatgatccccgtcatctgcaaagtctgcatggacccgagaacatacatcatcaaaaacgataagacactggcccaaacgttatgataaaaagcatctttggccaaccccattccgattaaacaggcctgaaaaggcatcgcaaaaaagtggaataaaaaatacggccacaacattttaaggtaaaacgacgccttgaccgaatcgaaaaataaatgggtcagcggctctgcaaagtgatacatcaccatgacggacggtatgccgtaaaacagcgtaataaagatcgcctgtttaatccgtttgatcactctttcgtattgcccgtaagcgtagctttcagaaatgctcgggatcatgacgaccatcagtgaatgggcgataaaagccggaaaaaagccgattgtcatcgcaactcccgaaagcatgccgaactggtcgatggccgatgttcttgatacgccagcggcaagcagcgtccccttcaccaaaaaaggttcgacggcatttgtcacagcatgaaacacgcgcagccccgtcgtcgggatcgaaacagtgagcaggcgttttaaaacatcgtttctccgcaagtggatctgctgccctttttgagcggcacgcctgaccaaaacaaactgcgaaaacaaataaacaaacacgaccacttcacttgcaacgaggacaaacaatgaaatgagaagagaagtatccaattcaaaggaataccattgaaaaaataaaaacaagccgatgagctgaaagatttttttcaaggcattcgccgttgcgattttacccatttgctgaacgcccatgaagtagcctctcgcgatcgatgtgaatgcaaccgtaggaatcatcccgatcacaagtcctctgattagagggtggtaagaatcaaaaaccggaataaatggaagaatgatcactgcggctgccgtggagaaaaccgtgcagaccgcagtcatccgcaatgcatgtttcagcatgctttcgtgcagcttcgggttggactcggcgataaacttcgatattgatacgggcagctcaaggctcgcaatcaccacgactaaaaaaatggaaggcaaaacactcatgtagagccccatgccatgctcgccaagctcccgtgcaagaatcatgttgatgacgaattcaagacattctgcaaaaaaagcagctagcgaaagaagaacgattccttttacaaaacggttcatgaggtctctccttgtctcacgggtttatcccatcatatgagacaagtctaaaaattattttctttttaattgaaaattgattttcataaagtatcaaaaataaattttttcttgggctgtgaaagatgataatgcgtaagaaagaatcgcacaaaaaaagcagccaaggcgaatggccctgactgctttctagatcgcaaagacatgattgccgatgcgcttcacgacttttctcgttttaatccagtcatcagaagcgatgtcgggattatagaaaaataaagcgtctgtttcttttttattttgatctaccgcttcttccacagcttccactgattcgcggtctgcttttttctcgatgctgccgtttagaacgggctcaaaagcgtttctttgatagatcacgctttttacgctgtcaggaaatcggctgtctttcacccgattcaggacgacattggcgacagccacttttccttcaaatgactcgcctttcgcttcggcgtgtacaagccttgataaaagatctttttctttatgtgtaagatcagtcgtctcttcttcagcttcttctatttcctcctcctcttcagctgacagatgcgcggcttcaatgaagcttttctcatctgtcaattgggaaaaagcaggattttcttcttgtttaaggctttccatcagccgttccatttcctgtttatcttttttcgagaacaacatgacagcttgagcatgctcgattcttgccgccggcagcatgcagattaaaaacgcagctagagcagcaaatttcgatttcatttccttcctccttgtcaaatcttcatcgaaaaaaacatatgttttacagtaacaagacgattcgccgatttcattgccaaaatgttggcatgacttccatcaaaccgttcggctgtcacattattgcagacagccggcggatttcatgcaaaaaacaccaaaatctccagaaacatatggcttcacacaaataaaaaaagctttctcagcctgtctgagaaagcttttttcagcttcttgcctctttcatatattgaaatataatatctccgccatgctgggcaatgccgcgaaaatgcttaaaatcttcctgctttgttaagatggctctgaaagaaagaaaatcctcttttttcacacggagctcatgaatgctccctgaccttaattgctcgatctgatcgatggcattttgctctgtcaacttttctctccccttttctctcatcatctttaactaattaactatatcattaagtcacaccgggtacaacaatagtgatgccgcttcccaaatcgctttacttctccaagaaaatattgcaaaatactttcaataggttaatttactttaaaggagaggaagtcacttgaaaattgcaaaagtcgggaacgtcatcgaatttaaaaacggactcaccggaatcgtagaaaaagtaaacgaaaactctgtgatcgtcgatgtcacgattatggaaaactacagagacttggaactggactccttaaccgtcgtcaatcataaaaactataaaattattaaagactccctgcattaatcagccgcccttcacagcaaaaaattcacgatttccacgaagctttatttccacaagtttttctacaaaaggaaaaccgcctgccaccttggtccggcggttttttcctctgtcccctgcatcatcccgaagaagtttgatatgttcaggatgtcttttgaagcatcgcacagcgccttaatcgatttttgattggacagctgaaaaaacggcgactgtgcgaaatgaaacacccgaacggttccccaggacattatttttcaaaatagatgatgaaatctccactttttctttcccgctcatatccatacagaaaattgatcggtttccaatctctttatcggttaggaagaccttatcggccaagcgtgctttttcttgaattatatcctaggtttttgttgattctattgtcactcaagtaaatggtgtaagtccccggggccagctcttccatgtcctcgatatcctggacaacttgattataaatgcgctcgtccggtcttgtatttggtttattcatatataaccgtatattgatatcacatgattttggggtgatttcttcatcttccaatttctcttgccagtcttttttgcttctttttgggttttctaaataggctgaataaaggtcatccttccaatcagcatttaaagaaacagcataataaggcgtctgatatcccataccgcttgtgttatcaacggctgcctgcgttttacctacaaccggctcttcttctgccagcttctctaaatagtaatctagagcggcaaattcgtcttcaaaagccaacgcatatatcgcgcttgtaatcgagtcttttacgtcccactccgatgagctgatcgcgtcagcctgcacctctttcttgtccaaatcaatttcaatttttgcgcttgtgtagaaatgcaagtttccgactgattcggcatacacagtaacaaacccatgccctccgacaatgttatggacttttaccttcgttctatattgatccaaaaaataatcttttaccgttttttcaacttcatctcgatgcgcttctgcgatctcagcggtttccttctgataacctctactatgaatatgaaaatcctgtcctgtgtaatcttggacgctgatttcagcttccccgctcttctgacatccgcctataaataaaagtaaaccaattccaagtgctgctgctttttatatttcaaaaatgtatcctccagttcatactgcatgcccttatacgattttattgcattccgctccatgtttgctgattgttaggcccgcttcattataaaacatatggagtgcatttttggtactcaatatataaaacaggacaatagaactaataaaattcgcatcattaagttctttcgttctaggtgaaaaaaatgcccaaaactgcaatttatccattttagaggattaaacgtgcctactgaagaactattttatgttgaggaggcctaaaaggggtaataaaaaccgattagttaaacaaacgagagatgaaaatagaaaaaagcccgctcaatcgagtcgggccttttattaataatcgcaaattttatctttatattcgggctttctttcagcatcgactgtgaaggacccaacttcgtcatttgccttatcgtaaataccccatattttctttttcttatcatcatttagataccctttaatatcaattccgcccattggattcacttcgtagtcatcataataatcaattgacttaatgtccttataattcgttttaataaagtctgtcattctttccttagctaaattataaagctcttctttttctctgttattattttgttgcttcataaatattcctccagatgttataatgaccagagcaagaaggataattatgtattttttcataaaaccatcctttccacgttacattttacatagtttgcggggttatgtacctgaataaaaagagcgatattcctaaattaacagataaagagtattattttcttagccaaaacacatatagtaccgataaaatgaaagaagcattcaaggaaagaacacctatagagagtaaatacatgtgcgatttataatgaattaacaggtacgttttgtcttgtttagttttcaaagaacttcgctgccgctctcaaagcgaccacttaaatataacatttatgagaaaagcggtcaatacttttttgaaaaagtttttgttgttgtttttataagcgaccaagagaaattatagcacattatgttcctgatgaaaagattatatttgaaagattgaatagaaaaacatgcagccatttggctgcatgtttttatgattcatccgcttcctgttcttctgaatcgttctcttcatctttttcaactaaagcgacagtcgcgacatgctcttgttcacctaagcggataagtcgcacaccttgagtgacgcgtccggtcgtggagatatctttaatatccatccgaatgatcacgccgcttgctgtgatgatcattaaatcttcttctcctgtcgttgctttcactgtcacaagagatccgttattttctgtgattttgcaggttttcagcccttttcctccgcggctttgcaccctgtattctgaagcgggcgtcagttttccgtagcccttttcagttacgattagcacgtgtgaatcctcttccaaaatctccatgccgacaacaacatcgtcatctgtcagattgatgcccttaacgccggctgctgttcttcccatttgccttacatctgtttcagggaaacggatgagcagaccgttcttcgtgccgataataatttgtttatttccatccgtcaggcggacagcgatcaattcatcctcatcgcggaggcttaaggcgatcaatccattattgcggatattcgcgaattgagaaagcggtgtgcgttttgatattccgtgttttgtcgtgaagaacaaataagactcgtcatcaaattcgcctaccggaataatcgcgttgatccattctcctttttccacttcaagcaggttaataatcggaattcccttcgctgtccgtccgaattcagggatctcatatcctttcgcacggtacaccttccctttattcgagaagaagagaatggtgtcatgggtggatgttgaaatcaggtgttcaacgaagtcgtcttcatttgtacccatgccctgaatgcctttcccgccccgtttttggctgcggtaagtagaagaaggcagacgtttgatatatccgttatgagttaaagtcacaacgatattctcgcgcgtgatgagatcttcatcctcaatcgtctcaaggcccgatgtcacgatttcagtacggcgctcatcattaaagcgctctttaacttctgtgagctcttcccgaatgatttcaagaactttctcttcgtctgctaagattgcttttagctctgcaatcagctcaacaaggctttgatattcctcttcgattttttcgcgttccagccctgttaaacgctggagacgcatgtccaaaatcgcctgggcctgtttttcagtcaaagaaaacttctcaatcaatccgttttttgcgatttcagccgtttgcgaatttctaattagggaaataacttcatcaaggtgatcaagcgccactctcaagccctcaagaatatgggcccgcgcttccgctttgcgaagctcgaatgcagtacgccttctgatcacgactttttgatggtcgagataatgctccagacactgcttcaagctcaatactttcggctggccgtcaacaagcgccaaaagattaatgccgaatgatgtttgaagagcggtctgcttgtacaagttatttaacagtacattggcatttgcatcccttctcagttcaatgacgatgcgcattccgtttcggtctgattcatcgcggagatccgtaatgccgtcgattttcttatcgcgcactagatcggcgattttttcgatcagccttgctttattcacttggtacggtatttccgtaataatgattaccggtttgccggaagatgtttcttcgatttgagctttggctcgaagcgtaattgatccccggcctgtttcataggcctttcggataccgcttcttcccaagatcagccctgctgtagggaagtcgggtccaggaatgatctccatcaattccggaagcgtgatatcagggtttttgctgaccgccaaaacaccgtcaatgacttcaccgagctgatgcggcgggatgtttgtggccatacctacagcaataccggccgctccgttgacaagcaagttcggaaatctcgcaggcataacaaccggctctttttccgaaccgtcatagttgtcctggtaatcgattgtgtctttattgatgtcgcgcagaatttccattgatattttagacattctcgcttctgtgtaacgcatggccgcagccgagtcgccgtcaacagaaccgaagtttccatggccttgaacgagcatgtaccgatagttaaaatcctgcgccattctgaccatggcttcgtaaacagcagaatcaccgtgagggtggtacttaccgataacttcgccgacaatacgcgcggattttttatacggcttatcacttgtcatcccaaggtcgttcatcgcatacaatattcttctgtgcaccggcttcagaccgtctcttacgtccggaagagcgcgggaaacaataacactcattgcgtaatctaaaaaagatgtgcgcatttcctgactgatattgacttcctgaacttggggcttatgttgttcactcattaaaaaacctccctggagaatctacatgagttgtgtgggagtagatttgtatttatactcttcaacgaattaggctattctccattatatcaataatcttgattttatacacatcaaatgactagagcgccaaaggctcattctagaaaagaccttatttcaattaagcgaaaataaggtcttacaatcattaaatatccaaattctttacatatcgggcattctcttcgatgaagttgcggcgcggttcaaccttgtcgcccatcagcatttcaaaggtttcatccgcatcaatcgcatctttgagcgttacttgaagcaatgtccgcgtttctggatccatcgtcgtttcccaaagctgtgtcgcattcatctcgcccaaacctttgtagcgctgcaggcctggcttaggattttgcggaagctcttttaaaatttcttcgagctgctggtcattgtacgcatactcaacgcgtttcccctgctgtactttgtaaagaggcggctgagcgatgtagacatatccttgttcgataatctgtctcatgtagcggtagaaaaaggtcagcagcaatgttctgatgtgtgcaccatcgacgtcggcatccgtcataatcacgactttgtggtagcgggctttttcaaggttgaaatcttccccgattccggtgccaagggcggtgatcatagaacgaacctcattgttggacaatattttgtccaggcgggctttttcgacgttcaaaattttccctctcaaaggcaaaattgcttggaaatgacggtcgcggccctgttttgccgatccgcccgcagagtcaccctcaacgatgtaaagttcggaaatcgtcgggtctttagaagaacagtcagcaagtttccccggcagattggacacttcaagggcgctttttctgcgcgtcaattcgcgtgctttctttgcagccatccgtgctctggcggccataacccctttttcaacgatttttttcgctgaatccgggttttctagcagaaacttttcaagcgcttctgaaaatagcgcatctgttatcgtacgcgcttctgagttgccgagctttgttttcgtctgcccttcaaattgaggatccgggtgcttgattgaaataatcgctgtcaaaccttcccggacgtcttctccgcttaagttcggatcgctttctttgaatacgccgtttcttctcgcgtaatcattgatgaccctcgtcaaaccggtcttaaagccggcttcatgggttccgccttcatacgtatgaatgttgttagcaaatgaataaatgttgcttgtatagctgtcattgtattgaagagccacctcgactgtaatgccgtctttggatccttcaatatagaccggctcttcatgaataacttcccgcgaacggttcaagtgttcaacatagcttttaataccgccttcatagcagtattcattcttgcgttcttttccttctcgcttgtcttcgatcgtgattttgacgccttttgtcaagaaagcgagttcgcggacacgagtggcgagcgtatcatagtcgtattcagtcgtttccgtgaatatttccggatcaggcttgaagtgtgtggtcgttcccgtcacttccgtatctccaatgactttcaaatcagctttcggaacgccacgttcaaattcctgataatggatttttccatctctgtaaaccgttacatccagctcggttgaaagggcgttaacaacagaagcaccgacgccgtgcaaaccgcccgaaactttatatccgcttccgtcaaactttcctccggcgtgcaggacagtcatgatgacttccacagcgggacgacccatcttctcatgaataccgaccgggataccccgtccgttgtcttttactgtgatgctgttgtctttttcaattgcgacattgatttcagtgcagtaaccggccaatgcttcatcgatgctgttatcgacaatttcccatactaaatggtgcagacctttgccgcttgtcgacccgatgtacattccgggtcttttccgaacggcttccaatccctctagaacctgtatctgattttcatcgtaattattttgctgttccattgccacgcacattcacctacacttttcttcaaacataataaatttatagttaagattctttatgaatcgatttccggcttggattgcgcccgttttttcaacgtgcctgaggctaaaggagaaaaataaatcgattgtaatgtgacaacaattgacttcggcgtgctgttagaagagacaatccgctgtttttgcttgcttaaaaactcctcaacaatcggcgatgtctttgccttgtaatcaaaaatagccacaatttcacgcgttgagacgacaaaatcgtcacctaagtggatatacaatccctcaccccattttttcagtccgatagcgtgccattttcaacacgaaagatttccgcttcgtttaaggttttatgatcaattccatcaacgcttgtcgttgttacgaatgtttgaacgcggccttgaatggtgtggagcaagtgagactgccgatagtcgtccagctctgataaaacatcatccaaaagcagaatcgggtattctcctatctcttcctgaatcaagtcgatttcagccaatttaagcgacaatgcagtcgtgcgctgctggccctgcgatccgtaagtctgcacatcacggccattgacatagaaaagaacatcatccctgtggggacctgaaagagataccccccgttctatttctttatctcttaatttagaaaacgtttcttgataactattgatcattttcgacaaatcgggcgaatctgatacgtgaagagacgtatgatactttaacgtcagctcttccagacctcttgaaattccggaatgaatgggctgagcccatttttcaagctgatcgacaaactgaagccgtttcatcacaacctttgccgcgaattccgtaagctgttccgtcagcacgtcaagcatcgtttgatcggtttgctttctcgtttgaagctgcttcaagaaatgattccgttgtgaaaggattttttggtaaagagaaaggtcatgaagatagacaggtgatacttggccgatttccatgtcgagaaaccttcttctgacctgaggacttccttttacgagatttaaatcctccggcgcgaacataatcgtgttgacagccccgacatactggctcagcttctgctgttcaatatgattcactttacctttttttccttttttggaaatcacaagctgaatgggaacagaaccgttttttttaatgaccctgccttctattttagcatagtcttcatcccatcgtatgagttctttatcatttgacgtccgatgggatttcgccatcgcaagcacatagatcgcttccatcaaatttgtttttccttgagcgttctctccgataatcacgttcactttgttctcaaattgaaggtcaaggcgctcataattacggtaagacaataatgtaagattttggatatacaatcaataccacctgcttttagccgacgacttgaaatgaaccgaatccttcaatcgtcaccacatctccgacatacagttttcgtccgcggcggttatccggctcgtcattgacgagtacttcatattccgataaaaaccattttgccattcctccggactgaatgacatccgccaatttcaaaaactggccgagggtaatcatctctgtatcaatagccaccgtctttgtcattatatcgacctctttcaatatcactaatatctaattgtactaaaaaacagggaaagaaggaaaggggaaacttgcggtatgagcaatcaaggcagggcgagagcgcttttctccagaaaaaataagagaagctgccggaccagccggcaactttctattccaacaaattaatacgtccggacaggaagaattaattggacgatcgaatcgtcattcggcgtacggatcagaaaaggcctcatagcgcctgtgaagcttacatgaatgtcctctccttcaagaactttaagggcatccagcatatatttcggactaaaggatatctttaagtcttccccttcgatctgctcggcattcaccgtttcaacaacctttccgatttccggagagtttgaagaaatttcgatcgactcattggcggctgcggaaagtttcaccacgttgtttcgtccttctctcgccaaaagcgaagccctgtcgatcgcctggagaaattccttagtattgacaatcaagttcgttttgctttcctgaggaatcaggcggttcgtatccggatagtttccgtcaagaagcctggagaaaaacagaacgttttttgttttaaacagcacttgtgtttcggtaatcacaatatcgacaagctcctgatggtcatcaaggattttgctgagctcggttaagctttttcctgggatgacgacattgtatgaactgtcttcgttaatgtcgagcttagctttccttagcgcaagacgatgactatccgttgcagtgcatattaattcaccgccagtgacattccagtttacacctgtcaagattgggcgtgtttctgaggtggacactgcaaaaacggtttggcggatcaggtttttcagcagatcggtcggaatttgaaaagcgtgatgctcttcaatttgcggcaaaagcggatattcgcttgcatccaaaccgtttaagttaaactctgctttgccggagcggatgatcgttaagtattgattttgaacctcgatttccactgttgacatcggcagctttttgacaatttcactgaaaaaacgggcttgaagcacaatgctgccgggctgttcaattgtcacgatctctaaatcgccgtcttctttcgggataaacgattcaatcgaaatatcggaatcgctgcctgtcagagagaccccttcatcagaggccacgattttaataccggttaagatcggaatcgtcgttcttgaagaaacggcttttaacacatcttggacactttcgaccaggcggtctttttgaattgtaaacttcataatcatcctccttgcgggaatctattaattattatgttttaaaaaaatagcagaagtactagtaggggctgtggatttgtggataagtgaaaaaaagaacggaaacacagcctatccacatgtggacagactgtgtaaggccatgttcaagttattcacactttcccgctcatcacttatctcagctgctctttaatttctttaatctgctgctgaagctgttcatcatcgttcagcagttttgatattttctcatgggcatggatgaccgtcgtgtggtcgcgtccgccaaattcttcgccgatcttcggaagagaagaatctgtcatttctcttgatagatacatagcgatctgccgcggaaaagccaccgattttgtccgtttcttcgccttgaaatcctccagcttgatattgaactgctggccgacgattctttggatgtctttgatcgtaatgactttcggctttgaagaaggaatgatatctttcaaagcttcagcagccagatcggcgttaatgtctttattgatcaaggaagaatatgcgacaaccctgattaatgccccttccagctccctgatattgctgtcgatctgattggcaatataaagcatgacttcattcgggatatcaagtccttctgcttttgctttctttcttaaaatcgcaattcttgtttccagatcaggaggcgtgatgtcagtgatcaatccccattcaaaacgggagcgcaaacggtcttcaagcgttgggatctcttttggaggccggtcgctggaaatgacaatctgctttgtttcttcatgcagcgtattaaacgtatggaaaaattcctcttgcgtctgttcttttccggctaaaaattgaatatcgtctattaaaagaacgtcaacatttcgatagcgattgcgaaaatcgacagctttattgtcacggatcgagttaatgaactcatttgtaaatttctcagatgacaaataaaccacttttgcagatggattgtgatcgatgacatagtgcccgatcgcatgcattaagtgagtctttccaagtccgactcccccgtaaataaacagcggattgtaagctttcgccggggcttcagccactgccaaagacgctgcgtgggcgaatcggtttcctgaaccgataacgaacgtatcaaatgtatatttgggattcagcatgttttgcggaaaatcagccggttcttctttcgacatttttttgattggagactttggcataaaatcttcttcattttgattctgaggaatgacaaatttaatgctcaattcttctcctgtcagatcatagatcgtatcggcgatcaggtgcaggtatcttgattcaagccagtctctggcgaactcgttcggtgcggtgatgatcagcgtatcgccctgcaatgaatgggcctttgtcgatttcatccatgtttcaaagctgggcttgctcaattttttttcgatctgccccaaagcttgattccaaagatccgatatgtttttcataatggcggttcgtccctcctttaccagcaatatttgcttgtccaacctgttatagaacacaaaaaaagagcaaatggatgagtccattcgttaatgaaatgttgaaaacatataatatagtagaaaaacgtcttttcgacatttttcacaagatgtggacaaaatactgcacaccctgtgaaaaaactttccacaacttatccacagtttgtggataatggattggcagccaatttgttatcaagagttaaaacacaaatataatatcagaataagcgagtggttgcaatggttgcgaggaacttatccacatactatacaaactgttgaagaaatattgtccacaacggttagttttgtgaaaatgttgtcgataatgattgtggatagaaaaaacgaggagaaagatatccacattggctttttttcgcttcgtccatcccgttttcccgcttccaaaaaaatcttttaagctaaaattgaggaaaaatgaaattaggctttcgaagaaaattgatatgtgttatcctattatggtgcaaaaaagaaatgtgtgagcgaagttgacaatgaactgctcatcccaatataataaattagactgtctttaacagctattcctcgagggaggtgtcatacatgaaaagaacatttcaaccaaataaccgtaagcgcagcaaagttcatggctttcgcagccgtatgagttctaaaaatggacgtcttgtattagcacgtcgtcgccgcaaaggaagaaaagtattatcagcttaggccactgaataatgtcagtggtcttttttacatagaggaatgaccaggcccatttgccagcttgttatcggagtgaaagaagatatgaaaaagcgaaatcgattaaagaaaaatgaagattttcaaaaagtatttaaaaagggaaaatcgatggcaaaccggcaatatgttttatatgtgcttcaccagcctgaagcgaaagagtttcgggtgggactgtcggtcagcaagaaaatcggaaacgcagtcgtgcgcaaccgggtaaagcggctgattcgccaggtcatccaggaagagcggaatctattaaaacaagaaaatgactacattatcatcgcaagaaagcctgcagctgaattatcatatgaagagacgaaaaaaagtttgcagcatcttttcagaaagtcgtttgtctaccggaaaaaaccgaatcagccatcatagtccgggttaaaagaagttatggcccctcatttttaagcgcttcctttagctccagaaaaatgtcgtcgcccattcgggggagaaagatgataaaatacgagaaagtatgtctttttaatggtcataaccgaataataccggttgaagaatgaagatttaggaggaaatgttgttgaagaggcgaattttattattgttcagtatgatcggcgttatcgtgcttttagctggatgtacggaaatcaaccagccgatcactgcagaaagcgaagggttttggaacacgtatatcgtatacccgttgtcacagctgatcacgtatgtagcaaatttaacgaatgaaaacttcggactagcgattatcatcgtcacgatcttaatcagacttttaattttgccgctgatgatcaagcagacgaagagttcgaaagcgatgcaggctctccagcctgaaatgcaaaaacttcgtgaaaaatacagttctaaagatcaaaaaacgcagcagaagcttcaacaggaaacgatggctctcatgcagaagcacggggttaacccgcttgccggatgtttcccgatcttaattcaaatgccgattttaatcggattctatcatgccattatgagaacgcgggaaatcgcagaacacagctttttatggtttgaccttggggagcgtgatccgtatttcattttgccgattctcgccggtgtgttcacattcattcagcaaaagctgatgatggcgggaacagcgcagcaaaatccgcagatggcgatgatgctttggctgatgccgatcatgatcgttgtatttgcgatcagtttcccggcggctctttccctgtactgggtagtcggtaacttattcatgattgctcaaaccttctttatcaaagggcctgatctaaaggctgagagacaggaagcggcagccggaggaaaaaaatccggaggtaagaaaaagtgaaggaactgactgctactggacgtaccgtcgatgaagcagtgcaatccgggcttgaacagctgggccttcatgcagatgatgtcgaagtcgacgtagttgatgaaggaaaaaagggattattcggcattttcggtcatcggtctgcagtcgtgaacattcgggaaaaaatagacccggttaaagaagcaaaacaatatttggaaaatgtaatttcgaatatgggaatacaagcccaggtgacggcagaagaggagtctaaacgagtggtttttcagttgaaaggagacaaaacagctcttttaattggaaaaaggggacaaactttaaatgcccttgaaacgctgacgcagctcgtgctcaatcgtcattccgacagatatatccaagcggtggttgacgccgaaggataccgcgcaaagcggaaggaaacacttgctcagctggcattgaagcttgctgaccaggcggccaggcagaaaaaagacattcacctggagccgatgccttccagtgagcgcaaggtcatccatgatacgcttgcgggctactcgcagcatatcgaaacttactctaccggtgaagaccataaccggcaccttgtcatctcatataaaaaataacatgaaaaccgaagttcccaaaattggggcttcggtttttttgccgttgaaaatcgatgaaatgcagcaaaatcagtttaagttctattttttcaggcgtaagctgttgatgaaaatgaaatttaattgttattcacatgtggataagttaaagtaagtaatgatggcttagaacggttgtggataacggttcaagtcacttccacttcaattgaaactatgttatctttaaattttgattacaataaaagtttttcatccgtatacgatgtttggaagatgacccggcaaatggggataatagatataggaatgaaaaagagaggtgaaagccatggataccatcgctgcgatttcaacgccgatgggagaaggggcgattgcgatcgtccggatgagcggccctgaggctcttgcgatcgccgataaagtgtataaaggacctcgcggaaaaaggctgagttccgtcgattcacatacgattaactacggtcatatcgttgatccggaaacggaaaaagtcgtggaagaagtcatggtttcggtactgaaagcgccgaaaacttttacgcgggaagatattgtagaaatcaactgccacggcggacttgtgactgtcaaccaggtgcttcagctcgttttgagagagggagcgcgtctggcggaaccgggagaatttacgaaaagagcctttttgaacggaagaatcgatctttcccaggctgaagctgtcatggatctcatcagggccaaaacagaccgggcaatgaatgtggccatgaatcagatggaaggaaggctgtcttcactgatcaaacggttgagggccgagattcttgaaacattggcccacgttgaagtgaatattgactatccggaatacgatgacgttgaagaaatgacgcacaagatgctgattgaaaaagcgacaaaggtcaaaaaggaaatcgaggcgctgctgacgacttcagagcagggtaaaatattaagagaaggcatctcgacagttatcatcgggcggcccaatgtcggcaagtcctcgcttttaaacagtctcgtccacgagacaaaagcgatcgtaacggatattccgggcacgacgcgggatgtcattgaagaatatgtgaatgtcagaggcgtgccgctgcgtctcgtcgatacagccgggatccgcgagaccgaagacatcgtcgagcgaatcggcgttgaacgttcaagacaggtattaaaagaagcagatttgattttgcttgtcctcaattacagcgagtccctttcagatgaagacatcaagctctttgaagcaacgaagggaatggacatcatcgtcattgtcaataagaccgatcttgagcaaaagcttgatcttgatcgggttcgggaattggctgggaatcagcctgtcgtgacgacttccttattaaaagaggaagggattgatgagctggaggaagccattcaatcgctgtttttcacaggcgcgatcgagagcggcgacttgacatatgtcagcaatacaaggcatatttcactgctgcatgaggcgaagcgcgccatcactgacgcattggagggcatcgaaaacgatgtgccgatcgatatggttcaaattgatttaacaagatgctgggaagttcttggggagatcattggcgatgctgtacacgaaagtctgatcgaccagctcttctctcaattttgcttaggaaaataaaggaggaacaaagcatatgggctatgaagcaggccaatatgacgtcgttgtcgtcggcgccggacacgccggtgttgaagcggcgctggcgtcagccagacaaggcgcaaaaacgcttgtcttaacgattaaccttgatatggttgctttcatgccatgtaacccgtctgtcggcggacctgcaaaaggaatcgtcgtccgcgaaattgacgcgctcggcggggaaatggctaaaaatattgataaaacgcatatccaaatgaggcttttaaatacaggaaaaggacctgccgttcgggcgcttcgggctcaggctgataaattccaatatcagcatgaaatgaaaaagacacttgagaatgaaccgaatttgaccatgctgcaaggaatggtcgaacgccttcttattgaagacggggaatgccggggcgttataacccagacaggggcggagtaccgttctaagaccgttgttctgacgacggggacatttttgagagggaaaatcattcttggcgatctgtcatactccagcggaccgaacaaccagcagccgtccatcaagctgtctgaacatcttgaagagctcggctttgacctcgtccgttttaaaacagggacgccgccgcgggtcaacagtcattcaattgactacagcaaaacggaaatccagcccggtgatgaagtgccgcgggccttttcgtatgagacggtggaatatattacagaccagcttccatgctggctcacatatacaagtccggaaacgcacgaaatcattgacaacaatttgcatcgttcaccgatgtactccggcatgatcaaaggaacgggaccgagatattgcccgtctattgaagacaaggtcgtccgctttaacgacaagccgagacaccaaatctttcttgagcctgaagggcgcaacacccaggaagtctatgtccagggattgtcgacaagccttccagaagatgtgcagcgaaaaatgctttcaactattcccggccttgagaatgtgcaaatgatgcgggcggggtatgcgattgaatatgatgcgatcgtaccgacacagctgtggccgacattggaaacgaaaaaaattccgggactcttcacagccggacagattaacggaacatcaggctatgaagaagcggccggacagggaattatggccggtatcaatgcgggccggaaagcgcttggcaaagaagaggtcattctcagccgctcagacgcttatatcggcgtattgatcgacgaccttgtgacaaaaggaacaaacgaaccataccgcctgctgacttcgcgtgcagagtacaggctgctcctgcgtcacgacaatgcagacttgcgcctgaccgagatcggctatcagatcggcttgatttctgaagaaagatatcaaaagtttcaagagaaaaaagcggccattgaagcagagaaaaaacgccttcattctgttattatcaaaccgacaaaggaaaatcaggaatatatccgttcactgggcggcagcgagctcaaagacggcattcgcgcgaccgacctgatgaagcggcctgaaatgaattatgaaaccgtcactgctcttgcgccgcctgaacaaaaagtcgccggcgacgttgccgaacaggtggaaattcaaattaagtatgaaggatatattgaaaagtccttgcagcaggtcgaaaaactaaagaaaatggaaaataaaaagattcctgacagaatcgactatgacgcgatcaaaggcattgcaacggaagcgcgccaaaaattgaaagaggtcagaccgctgtctgtcgcacaggcctcacggatttccggcgtcaatcctgctgatatttccatactgctcgtttatttagagcagggacggattgccaaggttgcggaatagaaagggtgacggcatgaacattgagcaatttacagccggtttggagaagaaaggcatttccctttcctccttccagctggagcaatttgagacttattacgaatggcttgttgaatggaacgaaaaaatgaatttaacctcgattaccgagaaaaaagaagtgtacttaaagcatttttacgattccatcgccgcctctttttatgttgatttcaaaaagatgaacactctctgtgatgttggagcgggtgccggatttccaagccttccgattaaaatctgctttcctcaccttcacgtcacaatcgttgactcactgaacaaacggattcactttttgaatcagctgtcagacgctttgaagctggaaaacacagctttttaccatgaccgcgcggaaacattcggaagatcgaaagaccacagagaaagctatgacgttgtgacggcacgcgctgtcgcccgcctttcggttctcagcgagctctgccttccgcttgtgaaaaaagacggtttattcgtagcattaaaagccgcttcggctgatgaagaaattgaaacgggcaaaaaagccatcaaaacgcttggaggcaaaattgaaaccgtacattcttttcagctgccaatagaagaaagcgaaagaaacatcattgtcatcaaaaaacaatcgcagacaccgaagaaatttccaagaaagcctggaacacctaataaatctcctattgaaggttaaattattcgttttcttcaaatttcgtgatgtcacagaaggaaaattcatgagaaaatagaattataaaaatggcagtgtttaaaggtggtgtaggtacatgaagcattcattctctcgtctcttcggacttggcgacaaggaagaagaagcagagattgctgaacatgatacgaataaagaagaaattcaagagattccagtaggcgatataattcctaaccgttttcagccgcgcaccattttctcagaagaaaaaattaaagaattagctgcaaccattcatacacacggcattatccagccgattgtcgtcagaaaaacagagcgggaaggccaatatgaactcatagccggagagcggcgctggcgggcggttcaaacgctcgattgggagaaggttcccgctattattaaggatttttcagatacagagaccgcttctgtcgctcttatcgaaaaccttcagagggaagaattatcttcgattgaagaggcgcatgcttatgcaaggcttttagagcttcacgatttgacgcaggaagcccttgcacaaaggcttggaaagggccagtcaacaatcgccaataagctcagactgttaaagcttccggaagaggtgcaggaagcgatcttgaaaaaagaaatttcagagcgccacgcaagagcgctcataccgttgaaacagcccgaccttcaggtcaagctgctgcatgaagtcattgaaaagagtttaaatgtaaaacaaaccgaagaccgtgtcgtcaaaatgcttgagcaggataaacgcaagcctaaaccaaagagaaaagcgtacagcagagacgcgagaatcgcgatgaatacgattcgccagtccttatcaatggtggaagacagcggcgtcaaactgaatacggaagaagaggaatttgaagaatatattcagtttacgattcgaataccgaaataaaagctccctatagagcttttatttttttaggcaaaatatctatgggggagcgtctatggaatattatcgacaatatcattcattgcttttttcgattgcttaccgtatgctcgggtcttttcaagatgcagaggacatcatccaagaattgttcgcagaccttcaggaaaaagatatcggtcaaattgaccatattcaagcatatttaacgaaatcaatcacaaaccgctgcataaatgaactgcagtctgcccgcaagaagcgggaggtatatatcggggaatggcttccggaaccgcaggtggcgctttcagctcaaatcccggctgagtacgttgaagagaaagaaaaggtatcctatgcttttctggtagttatgagccgattaaatcctgtagaaagagccgttttgatgtttagagaagtatttggatatcattacaaggaaatttcgtccattatcgggaagtcggaagcgaactgtcgtcaaatccacagccggctgaaacagaaattaaacgaggatatttcggtattttcacagccggttgaagaacagcaattggcccagctgtttatcgaatcagcgaaaacaggtaattttgaggagttttccaagaaattgattgaagatgccgtattgtatacagatggcggcggaaaagtgcgcagcgctttgagaccgatctatggaaagagccgcatttatgcgttttttacgggagttgtttcaaagggaagcttttccggccgctttatgccagtcgatatcaacgaccaaaagggcgttttgatcatgaaaaacaaccgcccggcttacgcggtttgctttgcttggaatccggaaggcgattccgtcaaaaatgtgtttatcgtgtcaaatcccgataaactgaagcacattaaaatataacgttttttgtcacaaactccgtttctctcttgttatataagtgaaacacttaaaggaggaatagacatggaaacgagatttctaatggaaaaagtaaatcctgagggatacagaggaatgctggagcttgaaaaagcgcaggcttcttctggcattgaccccattttaaaggaactgatcaaaatccgggcttcacagctgaacggatgtgctttctgcttaaatatgcatacgaaggatgcaagacagaacggggaaacggaacagcggatatatgcgctcaatgcgtggcgggaagcgccttttttcacggaaaaagagcgggctgtattggcgctgactgaagccgttacgcgaatcggcgagcacgggttgccggatgaaatatacaacgaagtcaggacccattttacagaagctgaaacagccgaactgatcatggcagctgtcacaataaatgcctggaacaggattgccatcgccacccggaaaatgcccgcagcagattgattgaaatccccccaacacaggggggattttttatactgatataaaattaaaactatctttcactttatttgagcgtttcttctcttttttctaagataaaaaaactgtttctttttgtcgaaaaataaacaaaacagatctctttcaaaaaacaaaaactcaaaaaaagcaaacggccgattctttttttgttaaaatagagaaatgagagaaacttgttcaatgtgaaagtaggtgacattgtggggaaaattattgcgatcacaaaccaaaaaggtggcgttggtaaaacgacaacctctgttaacctgggagcttgcttagcttacatcgggaaaagggttttgttagtcgacatagacccgcaaggaaacgcaacaagcggtatcggcgttgaaaaggctgatgttgatcaatgtgtgtacgatatattagtagatgatgcagatgtgaaagatgtcatcaaaacaacatccgtagaaaacttggatgtcattcctgcaacgatccagcttgcgggggcggaaattgaacttgttccgaccatctcccgagaagtccggctgaaaagggctttggaatcggtcaaacaaaactatgatttcatgattattgactgcccgccgtcattagggctgcttacaatcaatgcgcttacggcttccgattccgtcgtgattccggtccagtgcgagtattatgcgctggaagggctgagccagctgctcaactctgtccggctcgtgcaaaaacatttaaatacggatctgatgatcgacggcgtattgctgacaatgcttgatgcaagaacgaatttaggcatacaggtcatcgaagaagtgaaaaagtacttccgcgataaagtatacaaaacggttatcccccggaatgtccggctcagtgaagcgccgagtcatggaaagccgatcattttatatgatccccgttccagaggagcggaagtctatttagaattagcaaaggaagtggctgcgaatgcctaaaggtctcggaaaagggattaatgcattgttttcaaatgttgatttatccgaagaaacggttgaggaaatcaagctgcaagacttgcggcccaacccttatcagccaagaaaaacgtttgatgaccaatcgttaaaagatttgaaggagtccattttgcagcacggtgttttgcagcccatcatcgtcagaaagtcaattaaaggctatgacattgtggccggagaacgccgtttccgggctgctgaaaaggccggattggaaaccattcctgcgattgtgcgcgagctgtcggaatccctgatgatggagattgccctattggaaaatcttcaacgagaagacctgtctccgcttgaagaagcaaaagcctatgaatctttgctcaaacatctcgatatgacccaggaacagctggcgaaaaggcttggaaaaagcaggcctcacatcgccaaccacttgcggctgctgacacttcctgaagacgttcaaaagttaatcgacaacggcacgttatcgatgggccatggccgaacattgcttggattgaaaaacaagaaaaagcttgagccgcttgttcaaaaggtcgtgtccgaacagttgaacgtccgccagttggaaaagttaattcaacagttgaacgctgatgttccacgtgaaacaaagaagccgaaacaagtcaaagatgcagtgatcaaggaacgggaatcgtatttgcgaaactattttggaacaccggtgaccattaaaaagcaaaagaaaaaaggcaggatcgaaatcgaattctactcaaatgaagacttggagcgtattctcgaattattggctcaagaagacgcataagcttaaaaaccatctgatcatgtacagatggtttttttatgacattcttccggtcattctttcaattggtgacacatggcgccgctgcgatccggtcttttccagatgcgacagcccgtccgcaagcacatttgccatgctcatgacaagattgagccttgtattttgcaggacaaaatactccataaaaccgctgacattgacaattccgttaatatgcacgtggccgacttccggcaaacttttctgaacgcctgctcccggcttcaaaggccctttgccgatttggaaagaccccacgcttttggttcgtccaagacaggcgtcgatcgcgatcataaaaggattttgatgctgctgatgaatatgatcaagcttttcatttaagttcacggcgtgaaccgggtcggcaagcgttccatagacatgaaaacgtgtcagctgctttgcggagagtttcattcctacgaggggaccgagcgaatctccggtcgagcggtctgtaccgatgcaaacgatcacgatgggccggtctccggcttcctttaaatagacggaaaggactttctctatttgtttaacagctagcggatccgtatgagaaatatattcattcattggttcttgagaaaaaattccgccttttcgattcataggcttcacatccttgtcatcatggtaacagcagtgccttggtgtgttttttgagtatgtatggttgtttacagtatatccagctgtctctttttttatgctttggatgagtcgatttggtcagccggaaaaaatactttactaagagaggatacgatattctattttgttatattaatataatttattcatttgtaagagaaaagtcgaaaagggtttcatgaatttttatagaggaccggcaatatagtgtcatgagcggagaaacaagcttaaaaactatattgttggggtgagcaaatcgtgtggagagccgggatgaagtggatgcttcttattttaggaagcttaataggtgcgggatatgcatccggccaggaaatatggcagttttttggtgatgaaagcggactggctatcctgttgtttacgatcatgttcagcctgtcaacctatattgtgatgaagatcagctatgaacaaaaatcagagcattttctgcctgtgctcgaaacattaatcggtccgatgctggctaaagtatacgatgtgctgatcatcctgtatttgtttacgacgacgattgtgatgattgcaggaggcggggtaacgctgcaaatctttcatatcccgttttggactggcgtcatcttgttttgtttatgcacagggttgttgtttttgtgggggctcaatggcatattgtccgttaatagctacttaatcccgattttggtggcggggctgctgtatgcgctgatttcttttcaaacagctcatcatcagccgtggctgctcaacttgactcatcaatacaactggcctgccggcatcgcattcacttccctgaacatattatctgttgtcgctgtattatctgcggtcggcaaagagatgaagggggtcggagaagcaaagattgccagcatattaagcggcctggtgtttggggctatttcatacatgtacaatgagacccttgtagagcttgccggtgaactggcccattatgaaattcctttattcgcggttttggagggcgcgccttttccgatttttatttttatgacggctgtactttgcgtcgcaatctatacgacgacgatctcgagcattctcggtctgtccagccgttttctgtcctttgtgaactggccgagatgggtgatcgtcatcctgcttctctcgatcatggctccttttacgtcaatcggattttcaaatttaatcgcttttttatatccaatttacggattattgaatttatatttattggtaaatattttactatatccgattttgagtaaatggaaataaatacagttaagattgtgaagaattgccctttcaccgtggttttttgtacaataaggtcacaacaaggaagcaaagaggtgaacgatgttggccgataaagaatttggcctgaatgacgtggtcgaaatgaaaaagccgcatccctgcgggacaaaccgctggaagatcattcggatgggaatggatatccggatcaagtgcgagggctgttcacacagcgtcatgatcccgcgcaaagagtttcaaagaaagctgaaaaagatattagttaagcatgaggagtccgaaagttaatcttggcggacctccttatgctttttttctgtctcaatgaaaaatgaattttcatctagtttgtatgattgaaaagcaagttttgtcagcttgtcttttattgtaatcatccttataattgttgcaggtttaacatttacgactacacacggatgttcattatagaggagatgaaacaatggctttaacagctgggattgttggtttgcctaacgttgggaaatcaaccttatttaatgcaattactcaggccggggcagaatcggccaactacccgttttgtacgattgatccaaacgtcgggatcgtagaggtgcctgatgagcgtctgcaaaagctgacagaactcgtcaatccgaagaaaaccgttcctaccgcatttgaattcaccgatatcgcaggcattgtaaaaggagcatcaaaaggagaagggctcggaaacaagttcctgtcccacatccgccaagtagatgcgatctgccatgttgtccgctgttttgccgatgacaatatcacacacgtgtccgggaaagtagatccgatttcggatatcgagacgattaaccttgagctgatactggctgaccttgaaaccgtggaaaagcggatcgggcgggtcggaaagatggccaagcaaaaagataaagaagccgtgtttgaatttgagattttgacaaagttaaaagaggcgtttgaacaggaaaagccggcccgctctgtcgagttctccgaagagcagcaaaaggtgttgaagcagcttcatctgctgacgacaaaacctgtcttatatgtagctaatgtcagcgaagatgaagtggctgatccttcaggtaacgagtacgttcagaaggtccgggaatttgcagctgctgaaaatgccgaagtcatcgtcgtctgcgcaaagattgagtccgaaattgcagagcttgaaggcgaagagaaggcgatgttccttgaagaactcggcattgaagaatccggtctcgatcagctgattaaagcgtcctactccctcctcggacttgctacttattttacagcgggagaacaggaagtcagagcttggacatttaaaaaaggaatgaaagcccctgaatgtgcgggcatcatccatacggactttgaacgcggatttatccgtgcggaaacggtcgcctacgacgatctgcttgaagcgggaagcatgaccgcagcaaaagaggccggaaaagtccgccttgaagggaaagaatacattgttaaagacggcgatgtcattcatttccgtttcaatgtataacgcagttgaaataggacaagagctttgatataatataaaattgtgagtaatagaattattgctccttgcccaatataatgggccgcttagtccaaaaggaggtgcaaatacaaatgagaaagtacgaaatcatgtacatcatccgcccagacgttgatgaagagtctaaaaaggctgttgttgagcgttttaacaacattttaacaactaacggtgcggagatcactgaaacaaaagattggggaaaacgccgtcttgcatacgaaatcaacgatttccgcgacggattctaccaaatcttaaacgttcaagctggagctgaagcagttcaagaatttgaccgtttagctaaaatcagtgacgacatcattcgccacatcgtggttaaagaagaagaataaacagaattgaattatatactctaaagcaaaaggatggtctctcaatatgcttaaccgagttgttttagtcggcagactgacaaaggacccagagcttcgttatactcctagcggtgcagctgttgccacctttacgcttgctgtcaatcgtacgtttacgaatcagcagggtgaacgtgaagctgatttcatcaactgtgttgtctggagaagacaagccgaaaacgttgcaaatttccttaaaaaaggaagtcttgcgggtgtagatggacgtttgcaaacgcgcagctatgaaaatcagcagggacagcgtgtatacgtcacggaagttcaagctgaaagtgttcaatttctggagcctaaaggcggcggttctggttccggcggttacagcggaggccagggaggccaacactttggcggcggacaaaatgaaccggctccattcggcggcagtcaaaacaatcagaatcgcaatcaaggcaacagcttcaatgacgatccattcgcaaatgatggaaagccgattgacatctctgatgacgacttgccattttaatggatgacggacgaataaaataaaaccagaacagaaaggagggaaataacgatggcaggaggacgcagaggcggtcgtgcgaaacgccgtaaagtgtgttatttcacttccaacggcattacgcacatcgactacaaagatgtagatcttcttagaaaatttatctctgagcgcggtaaaatcttaccacgccgtgtaacaggaacaagcgcgaaataccaacgtaaattgactgttgcaatcaaacgcgctcgtcaaatggctttacttccatacgtagcaggcgagtaagccgataaaaggaacaagacccaatgcggtcttgttctttttttatttatcaaaagccgggtcgtttccttcagcattcaggttttctgcttgccaatacgaattcgctttatatcgccgaggactgcgaggtagaacacgagcccgagcagtaatacaaatccggctactaaaaagctgagcgtaaatgaaccggtcacatcgaccagatagcccgttaatgaaaccgcgataatccctccgaataagttatttgccaaattgaccattgaactgagcagagagatggaaccaaccggtgcaatatcggctgatatcgaccagccgataggcgcggtcgcagatattccggctaagccgacggaaatgcaaatgatcgcaatcgtgatgttgtgcgtgaaaacagctcccagaaaggcaaatccaaggctcatgccgattacgataatggtctggtatacctttgtattcgaatgccccttttgaattaaaaaatcgacgagccatccgcccacaacgattccggaaaccgtcgatatcagccagggaaccgctgtaaacagccctgaggacataatgtccattccgtatgtttctttaaagaaggtcggcagccaggttaagagcaggttgaatgtatagccgtaacccgtaaatccgatcatcagcccccatactttacggtttgtcagcatcgcttttaaagcaataagcgtccgttccgagatatcttcctctgatacggcattatgcttttgaatataatggagctcttcctttgagattcgtttgtgccgatcgggctgttcataatacaaccagaaaaatacggtgaacagtacattaatgattccgatcgttaaaaaagcggctcgccagtcgaatgtcgtaactaaaaaggctacgagaggcgcgccgatgacattcgcgaacttggctgccgagtcaaacaaggaattggcaaggccgcgctcattaggcggaaaccataaggccgttgctttggatgcggcaggaaaagctgaagcactcgtcagcccgattaaaaatctgacaatataaagaagcagttttccctgtaaaaaagccaatataatggttagaaaactccacaaggtcattccgacccttgtcacccaggcaacgccgtacttatccaagagactccccaccggaatctgcatcagcgtgtatgagtaggtatagatggaaaagacgatgcctaattgggttgccgtcaattgaaaggaatcctgtatcgcaggagctgcgactgaaatggcaacacggtcaaagtaatttaaaatgatcatgctgcttaataaagaagaaatataccatcttgtatgccccggccgtttttccagctcttgcgccatgttgaaaccccctctaatccttagattggactcttttcaaaattacattcttaatttcttcgtgtttatttccacgggagtgcggggagtaaacggccgcggcaaaaaaaaccatatagacattttgatacaggtttgctaaagtgaaacatgttaaaaacagatggcttctatgagagttagaagcaaatgatcacgaacgaggtgttgaatctttgaatgttaaacaattaaatagcgaatggttttctaatgtacggggggatatcctttcgggtatcgtcgtagcgcttgctctcattcctgaagccatagcgttctccatcattgcgggtgtagacccgatggtaggtttgtacgcatctttttgtatcgccgttgtcatttcctttacgggcggccgtccggcgatgatatcagccgcgaccggggcgatggctcttttgatgggaactttggtcagagatcacgggcttgattatttatttgctgctacgattttaacgggaatcatccaattaatatttggggtgctgaagattgcgcgctttatgaaatttattccgcggtcggttatggtaggtttcgtaaatgcgctggccattttaatctttatggcgcaggttcctcattttgttggagtttcgaatatgacgtatgttgtggccggtattacgttgttgattatctatgttcttccccgctttacaaaagccgttccatctgcacttgttgccattattgcgatgactgtatttgccattttcggtcattttgatctgcgcactgtcggtgatttgggagaaatgaagcaatcattgcctgcctttatgattcccaatattcctttcaattttgagacattggccattatttttccaacagcctttgcgctttccatcgttggcttgcttgagtcattattaacctcttctattgttgatgatatgacggatacggaaagcgacaaaaacagggaaagccgcggacagggcatcgccaacattgtcgccggttttttcggaggcatggcgggatgcgcgatgatcggccagtctgtgatcaatgtaaaatcaggaggaagaggccgcttgtccacctttgttgccggtgtcttcttaatgtttttaatcatggtgctgggcgactgggtcgtacaaattccgatggcagctttggctggcgtgatgattatggtatcgatcgggacgtttgactggtcttcgtttagcatgttaagaaaggtgccgctgacggattccattgtcatgattgtaaccgtcgttaccgttgtggccacccacgatttatcaaaaggggttttcgccggcgtgattttaagcgcaatcttcttcgtagcgaaaatctccaaactaaaaattgaagaaaagtcagaagaaaacgcggtcaagtacatcatcaaaggacaagttttctttgcatcggttcaagatttcgtaaactcctttaaaacgggagagcaaacgaaaaaggtcattcttgatttttctgaggcccatatatgggatgattccgctgtggcggctatcgataaagtcgttttgaaaatgaaagagcaaggaatagatgttgacttgattggattaaatgaatccagctggaagctggtcgaaaaattagcaacctatgatcaacctcatcgttcagtgtcaaatcactaagaaacgggtgatgaagggtgtatagacatatactgctggctgctgacggttccaagcattctgaaagagctgccgatcatgcgattcatctggcttccatgtcaaacgaagcggtcgtcgacatgatttatgtattggattatgcgagagcaaaacatgaagtcctgcatagcgaaaaccgtacagaactcgaacgcgaacggcgcagcaggctgctgtcgatagaaaataaattaaaacaggcggccgttccctatcaaatgacgatgcagcacggggatccgggcccggccattgtatcgtacgccaaccatcatgatgttgatatcgtgattatcggaagcagggggctgaacactttgcaggaaatggtgctcggaagtgtcagccataaagtggcgaaaagagtgaagtgtccggttttaatcgtaaaatagcaaaaaacagagccagtgaggattctatcctcgctggcttttttatctcatcgatatcgctttttgcgcatgcatggcgtcgccttttagcaggtcgacgaggttataggcgggatataagcctctttggtacataaaataaaaaacttgttcatgcaacttaatggccgcattgatttgtttaacaagcactctcctgagctcgggcgtcgccgtttccgtgatcgcaatcgcatagtttcgaacggtcgttttcgccagcaccaacagatcacccgcatcaaaatacaagtcagcccgttcatcctcccgctgaaatgccggagcttttggcaaaaagggaagaagctctcttaaattttgctccaatgcttttgcttttgctgacacgctgtaaagctgtcttaactgagggtcgctgattttcttcatgcttttcttgatcttcaccaatccgacagactgtgccgcgattagttcatgcaactccaacgtttcatgccaagccaatgtttttgttgtcattcatattctcctttattgctttttcttagtcagcatatgcccattaccgtctaaaggttaagaagaatctgagggacgttttagaccgttttggaaaggggaagtcaaataatacgggatttttgcatctaagtgacaacagtgagaggtgatcaatgtgttggatatgttgaaggacttttttctatttttgagcggagggcttcgcgtgacgcttctggtcgcagttttgattatattgttgctgatcagaaaggcgagaaagaaaaataaagaaaaatcggggtttctcgactgacactgtttcacatggaacattcactcgctttctcaagccttatgatcgttttacttgcgatttgaccttatgttagaataaagaaacaatgagagaaggccgagacctgctcatctcatcgtctttatttgaaaatgaaattgcgacgttagaaaagagcagtcgtctatgctgctctttttgattcatgacatttcaacatacgaggtgaacaagtgaaacaaacaagagctttagtagaaggcgctatcatggtcagtatttttgccgttttgctgatgatcagcctctatattcctttcatcggaaccattcttttattgacgctgccgctgcctgcaatggttcaaacgatcaggcacggtctaaagccggggatttcggtggggttggtcagtttacccgtttcattgattgccggttccttaggcggactgatgtttgctattccagtaagtgccgcgggcgtgatcatgggcttttactacagaagaaaagagccggcccaagcgattgctgcagcagccgttacatatatggtttcgttcgtcctgctgcttatcatcagcattcagtttcttggattaaacttaatagagacggccaatcaagcatataatgaaacattcaaaacctttgaatcgagtatcaaacagtttggaaatgataaagaagtggctaagcagattgaattgttaaatgagcaattcaaacaggcgcaatatttatatccgacggccattgtgatattttccggaatcactgcgtttttgaatcatctgctcgcaaagccggtgcttcggcgcatcatacaaataccgtctctgaaaccgttcagggatatgagacttccgcaaagcattatttggatctatttgttgacgattcttctgtcgctggctcccgttgaagagggcagtgtatattactctgttctgttaaatgcgagtctcatcatgggctttgtcttggtcatccaagggttttcatttgtgttttacttttgccatgccaagaaactgccaactgtcctgccggttctttttttaattatcgggttgttttcgcccctgctgtaccttgttcgcatcttaggtataattgatataggctttaacttgagagaaagagtgaaaaaatcgtagccgcgatgttctccaatggtgaggagttgatttgagtgccaagtttttatgaaaaaccgttatttcgatatcccatatattctttaatcgtcgtcacaatcatttctgtcctcatcaacatttattttaattgggtggcaggggcggccggcgttctgattctgggtgtcattttgtactttttgaagcgggccgactcccaaatcagaaaagagctggacgattatatatcgacgctgtcttatcgtctgaaaaaagtcggagaagaggcgctgcttgaaatgccgatcgggatcatgctgtttaacgatcagtactatatcgaatgggccaatccttttatggcgtcatgctttaatgaaaatacgctcgtcggccggtcgctttatgatacttgtgaatctgtcgtccctttgattaagcaggaagtggacacagaaacgattacgctgaatgagcggaaatttaatgtggtcatcaaacgggaagaaaagctgctttatttctttgatgtcacagagcagacgcagattgaaaaacaatacgaaaatgaaagaacggttcttgcctacatctttctcgataattacgacgatgtgacgcaagggcttgatgaccagaccagaagctcgataaacagtgaagtaacatcgcttttgaaccagtgggcccaagagtacggcattttcttaaaacgggtttcctctgagcggttcatcggcgtattaaacgaacatattttaagcgagctagaagcatcaaagttttcgattcttgatgaagttcgggagaagacatccgttcataccatttccttgacgttaagcatcggaatcggtgcatctgttgcctcgttgaaagagctcggcgatttggcgcaatccagccttgacttggcgctgggacgcggaggagatcaggtggcaatcaagcagccgaacgggaaagtgaagttttacggcggtaagacgaatcctatggaaaaacggacgcgcgtcagagcccgggtcatttcacacgcgctcaaggagattgtctctgaaagcagcaatgtgataatcatgggtcataagtttcccgatatggattcgatcggatcagccatcgggattttgaaggtcgcacaggcaaacggcaaagacggctttgtcgtgatcgactccaatcagatcggttcaagtgttcaaagactgatcggggagattaaaaaatacgaagaactgtggtccaggtttattacgccggaagaggcgcttgagatcgcaaaagacgacacgctgctcgtgatcgttgatacgcataagccttcttttgtcattgaagaaaggctggtcaataaaattgaaaatatcgtcgttatcgatcatcatagaagaggggaagagtttattaaagacccgctgcttgtctatatggagccgtacgcttcatctacagcggagcttgtgacagagctgctcgaataccagccgaagcgcttaaaaatcaacatgatcgaagcaacagctcttttggccgggattattgtcgatacgaagagcttctcgctgcgcaccggctcccgtacgttcgatgcggcgtcttatctgcgcgcaaaaggcgctgacactgtattggtgcaaaagtttttaaaagaaacggccgatcattatattaaaagggcgaagcttatccagcataccgttttttatcaaaacggcatcgccattgcatcgctgccggacgatgaggcggacgaatactttgaccaggttatcattgcacaagccgcggattctcttctgtctatgagcgatgtcgaagcgtcatttgctgtggcgagaagagacgagaacacggtatgtatcagcgcaagatcgctcggcgaagtaaatgttcaaatcattatggaagcgctcgagggcggcggtcatttaaccaatgctgcgacacagctgaccgatatcacggttgaagaaacgctccgccgactgaaagaagcgattgacgagtatttcgaaggaggcattcagaaatgaaggtaattttcttacaggatgttaaaggcaaagggaaaaaaggcgaagtgaaaaatgtagcggatggatacgcgcacaactttttgatcaaaaaagggctggctgttgaagcgacatccgccaatatcagcgcgcttgaaggtcagaagaaaaaagagaagaaagaagcggctgaagaactgaaatctgcgaaagagctgaaaaaacagcttgaggagattacggtggagctttcagccaagtccggagaaggcggccgtttattcggctccgtgacaagcaaacaaattgcagatgcgctgcaaaaaggccatcagttaaaagtcgacaaacgcaaaatcgaattaaacgatgcgattcgctcattgggatatacgaatgttcccgtgaagctccatccggaagtacaagcaacactgaaagttcacgtgaaagagcaatcataaagtaacaaagccccttcctcagaaggggcttatcttttattccgtacgttttctcatttcattcgccaagaattcgacgtctgtaccgatgatcacctgcacctcgtgctgattgagcttgacgaatcccttcgctcccatggatttcatcgcgctttcatccagcttggaagcatcgcggaccttgaggcggaggcgggtcacgcagttgttcagcgtctcgatgttttcttttccgccaagcgcttcgatgtatttgtccgcaagggtttcgtatttagacgatcctgtgtcagggctgacagcggtgttttcctgctcatcgtcatcttctcgtccaggcgttttcaaattgagcttcgttatcaagaaataaaagatgatgaaataaataatgccgtaaacaagaccaagcggcagcaagagcagcggctttgtggcgattccaaagtttaagagatagtcgatcgtcccggctgaaaaggtaaagccgtgatggatgccgagcatattggtcacggtcatggcgcttgcggttaacaaggcatgaataccgaagagaagcggcgacaggaacatgaatgtgaactcaatcggctctgtgattccggttaaaaatgatgtgaacgccaatccgatcagcaacccggccgttgctttgcggcgatgctttttcgcagcggcaatcatcgccagacacgccgcaggaagaccgaacatcatgatcgggaagaaccctgtcataaaggcgccggcgcttggatctccggcaaagaaccggttcatgtcacccgttttgcctgcaaattctccaaagaccatccagaccatgttgtttaagatgtgatgaaggccgagcggcaaaagcagcctgtttaaaagaccgaatatcccgacccctaatgcccccgcatgaatgatccatcctccaatggcgtcaattgcctgctgtgcataaatccagacgaagccgaaaatgcctgcaagaatgatggaacagaaggctgtcataatcggaacactgcgttttccgccgaagaaaccgagccagtcaggcagctttgcatctttaaagcggttatacatgacggcggcgacaacgcctgcaataatcccgccgagaactcccatgttcaggtccttattgatggctgctaagccgcctgtcaggacaaaataaccgatggctccggacagagcggcggccccgtggccatcctttgacaatccgatcgcaacgcctatcgcaaagatgatcggaagttggtcaagaattgattgtcctgaagcagcgataaacggaatgtttaacaggtcttcccgtcccagtgcgagcaggaggcccgcagcaggaagaacggcaatcggcagcatgagcgcgcggccgatattttgaagaaatcccaacatagttaaaacccctttcgatgatattgaatcgcttttttcaaatgtccattttcatgggataaacagcggcgggcatcttcaagcgttccgtttgtcaacgtcataaagatcgctgccttgatgtcattgccgctttcttttaaagcttgcagagcctcatcctccgataacccggtggtattcatcagaatggtgacagcgcgcccggctaatttttgattgagcagcctcatattcaccatctcgttttgatagacgcggccaagcctcaccattgccgctgttgacagcatgttcaagatcattttctgagcggttcctgctttcagccgcgttgaaccgcggataatttccggtcctgtttgaacctcaatcgcgatatcgcttaatttgcccgcttctgtatccgcgttgcagctgatcgaaacagaagcggctccgatctgtttggcataggataaagcgccgaggacataaggggtcgaaccgctcgcagtgactccgattaagacgtcatctttcgagaatgattgcgctttcaggtcagcgacgattttttcacggtcatcttcattttcttcaagaggcatccacattgcgtcatatccgccggcgatcaggccggtccaacggctctcgtcaatagagaaggtcggcggcagttccgcggcatcaagaactgcgattctgccgcttgtgccggcgcctgcggtaaacactcttccgccttgctcaaaacggctgacaatcgtctccgccgcttcagcgatcaggggaaggcagggcgtaatggcgcgagggactgtgtgatcctcctcattcatcaaggtgacgatatctaaagcattcatttcatcaagtgctgtgcttttgtcgttcgtatcctctgtcttcctcattggtctttcctcttcatatcaatgacgaatttatagcggtcgcctctgtaaacggatttgaccacttcaaacggtctgccgtcgtccaaatagctcaagcgttcaatgagcaggactggtgcgccttcctctatgtcgagaggctcgctctctgcctgagaggcaatcgccggttctagtgtttgcgcggcccggtcgatcgtaagggagagcgtattttcgacatagtcgtacaaagatgcgctcataatgtcttcggtcaggccgttaatgaagtcggcgggcaaataggagatttcataagccatcgggatgtcatcggcgaggcggatccgtttgacttcatagacggaagccccttcacgtatctccagtttgcgcgctgtgctctggtcgcacgggatgacgccgaagccgagcattttcgtgccgggcctcatgccccttgatttcatgtcctcggaaaagcttgtcaatcctttgagaggctgctcaatttttggctcggcaataaatgtcccttttccccgctgccggacgagaatgccttcattgacgagattgttaaccgcctgtcgaacggtcatcctgctcacctcatatttttctgcgaactctctttcagaaggaatgaggtcgccgggtttcaaatcttttgtttcggcaagctttttaatttcggtctcaatctgatagtaaatcggaatgtgggaatcttttttgatcaaaaggccatacccctttctttcacgattgataaagcatcgctgtccgctatgatgacgacgtcttggtgcgtttttaagacggaagcgggggtgtcttcatttggttcttcagtgagcagcttcgccaagatgccggcttttttctctcctgaaacgagcagcaggatctgcttgcttttcatgatcgtggaaatgcccatcgttattgcttgcgacgggacggcgtcataggaatcaaaatagcgggcattggcttctttcgttgattgtgtcagttcaaccgtatgcgttttcgatgaaaatggggtgcccggctcgttaaatccgatatggccgttcaagccgaggccgagcacttgaagatcaatgcctccaagccgctcgatcagcgcttcatagcggctgcattcggcatccaggtcacaagccatcccgttcggaagatgggtgtggctgagcgggatgtcaatgtgatcgaaaagctgttttttcatatagaatgtatagctgttttcatgatccggggaaacgccgacatactcgtctaagttaacagtatagacgtgcttgtaagtcgttttattacgcgcatgatcttcccttaaaacctgatatgtgccgagaggcgttcctccggttgcaaggccgagaacaggtgcagataagcgattcacttgctcgatgatgaatcgggcggctgtttggctcatgtcctgataatctttagcttcaatgatcttcatggtgaaacctcccttttgctgaaagcaatcacgcctttgcaaagcgtcatcacaacttcatttttttcatttaaaatgatcaaatcggcatctttcccgctccgtatgctgcctttccggtcataaatatgaagctgtctggcaggattgactgctgtcatgtagacgatatcttcgagtgaacatcccgtaaaatccatcatgttcagtgcagcctggttcatcttcaagatgctgccggcaagcgtaccatcccgtaatacggctttttcgccttttacgaacacctcctgtccgcctaatgtataggttccatttttcaagcattttgcgcgcatggcatccgtaattaaaatgatgccttctttctgtttttgctgaaatgccagcttgatgacggcagggtgaacatggatgccgtcggcaatgacttcagccttcagttcatcatgcagaagagcgctaccggcagtccccggctcgcggtggtgcagcccccgcatgccgttgaacaaatgggtgacatgggagaggccggccttaatcgcggcttccatctctttgagtccggcgtcggaatggcctgcggatgcgatgacccctgtttccttcaaaaaggaaattagttccaaagacccttccagctctggcgcaagtgtgactaatttaatgttattccctgagatgcgctgccattctttaaataacgaaagatccggcgctataatgtcatccggcggctgggcgccgcaccgcttttctgaaataaaagggccctctaagtgaacgcctaatacttcggctgttccgggccgtccgccggcttccctataccggtgaacgtttgccagcgcatgctcgatcgtggctttatcttgggtcatcgtcgtcgcaaggaagcttgtcgttccttctttcggcagggcttcagccattgtttgcaaagcctcggctgttccgtccatgacatctgcgccgtttgccccgtgaatgtggacatcgatcatgcccggcagcactttgaagttctccggaaatgtcagctgttctgccgtttgtgcggaagctggaatatcagccattggtccgtaagcctcgattttttctccattcgtcagaagaaaaccgtcttctatcattccattttcactgtaaatatgaagatgtttaaaaatatagcgttgagatggtttggttttcacagtcaaaagtcctttcttgaaaacgttatcatcagtatagaacattacaactctagttgtctagaccaataagtgaattatttttgtcaaatctgatcatacggcatcacggtttatttggccgctggtttgtcaggttatattcaaaaaaaaagccggcttatctgccggcttcgttatgctgctttagcatagatatattgatttcttcccgcaccgagtcctgcaccgatcaaagcgaccagcgcgccgatgaacagtaaaatcggtccgttccatgagtgcatgtgatcgtaaagaaaaccgacaaagcttggaccaatcgctgccagcaaatatccggcggattgcgacatccctgataatgccgcggcttgatcggcattttcgcttctcagcccgattaaagtcaaggctaaactgatgctggacccttgtccaattccgattaaaatgacccatagcgtcagcatcgctgtactgcctccgtacaatagccctgacatccccgccaagtataggatgccgagggcgagcacgatgcttttctggttttgaaaccgcccggcgagaaccggagtcaaaaatgtcgacgggaggctggcaaactgcatcagcgacagcatccagccggcaagcgacatgctcatcccgtgcgagcggagaatttcaggcagccaggcgatcgtgcagtaaaacaaaaacgactgtatgcccataaagaatgtgacctgccaggcaattttcgagcgccagaccgtttggccgtctgcctttaagctgaccgtgcggtttcccgtatcatgatagcggagctggggaacccagatcaaaatcgcaacaaacgcgaggcccgcccaaaccatgagcgacgcgctccatccccacgctaagccgtgcgacaacggaatgctgatccctgatgcgagcgccgcaaaaatcgacatggctgttgtatagaaacttgtcataattcccgctttgtcaggaaatttatgtttgatcaggctgggcagcagcacattgcagattgcgatgccgactccgatcaatgcggttcctgcaaataatgtaatagattctccgtaagagcgcagcaaaattccgatcaataagatgaccaatccgacccagagggttctctcattgccaagcttctgtccgagcttaggggcgaccggggacaggacggcgaacgataacagcggcagcgtcgtcaagaagccggccatgccgttcgtcaaatccatatccgagcggatcgaactgatcaatggcccgacagctgtaatagccggtcttaaattaaaagcgataaatatgattcctgcaatcaaaaagatattgttcaaacgggcgcgtcgagcgtcaatgtaatgcatgctgtattctcctttgcttccaggtggaaaagtgacatgaaaaagaaacccggaccatcatccaaggttactattgatctttcttctgaatttcggcaattttcgcaagcaggatatgctgcggcaaatgcatgatttgttcaagaggaagatttaaggtttccgaaagtttttgcgccgtttcggcagaaatttgtaaaggtttcataaagtcctccattttatattgtaccccagcgcgcagagtacgcaacagtgaatattgactccaatatatattgtaacatcatatgacaagtgagttggaagaaaaagaaaaaagcgatataaataaagcggaggtgatcgtcttgaaatcgacgatatcggagctgaaaaagaaattgtatgaacagcagatcagagcaaaagggctttacacatttgaagagtacaaagatatgcgcaatgtgctgcaaacgctgcggatgaaatttgcggcctatgaagaatgggatttgtaccaacatgcgaccgatttgatggtcagcattctcttgaaaaacagttggaacagccgggtggattaattgtggaatctttaaaaaaacacctcggccgaggtgtttaataagaccgttcgtcttctttgttgtcctgccggtcatagatgacaagcttcgcaggacggttctctttcgccatctcttctcctttttccacggcctctgtccttgtatcataaagctcaacaggcgccgtatcttccagtttcaaaaaccacccgtctgtctcggcatttggtgataccgtataaaccttcatgaaaaacaacctcccgaaacttgtttactgatttgtttcccgtatagatcagggaagcaaacattccgacagctgttctccctttctatgaaaatatttctacaacatgcgattctgcaagagtctattttttttctgtaaaaatggtaaaatagacgttgggttatttttaaatgggaggacggtgcttaacatgacagatcttctgaatgacaggctgccgccgcaaaatatcgaagccgaacaggccgtgttaggtgctgtttttttagaaccatcagctttaactttggcgtcagaagtcttgattccagatgatttttacagaatgtcgcaccaaaaaatatttaacgccatgcttgttcttggagaccgcggcgagcctgtagacctggtgacggtgacatcagagcttgcgaacacggaccttttggaagaggttggcggcatttcttatttgacggatattgcaaattctgtgccgactgcggctaatatagagtattatgcaaaaatcgtggaagaaaaatcgattctccgccgcttgatccgtacggcaacgacgattgcccaagacggatatacaagggaggatgaagtcgaagacctcttaagcgaagcagaaaaaacgattatggaagtcgcccagcgcaaaaactccggggcctttcaaaatattaaagatgttctcgttcaaacctacgataatattgaacagctccacaacagaaaaggggacatcaccgggattccgacaggttttaccgagcttgacaggatgacggcgggctttcaaagaaacgatttgatcatcgtagccgcccgtccgtcagtcggcaaaaccgcttttgccttaaacatcgcccaaaacgtggcgacgaaaaccgatgaaagcgtcgcgatcttcagccttgagatgggcgccgagcagctggtcatgcggatgctctgtgcggaaggcaacatcaacgcccagaatctccggaccggaaacctgacggaagaggattggggcaagctgacaatggcgatgggaagcttatcaaacagcggaattttcatagatgacacaccgggaatccgcgtcagcgaaatccgttccaagtgcagacgtttaaagcaggagaacggcctcggcatgattttgatcgactacctgcagctgatccaaggaagcggcagatcaagtgacaaccgccagcaggaagtatcggaaatatcccgtgcgctgaaagcgctggcgagggagcttgaagttccggtcatcgccctttcacagctttcccggggcgtcgaacagcgccaggataagcgtccgatgatgtcggacatccgggaatcgggaagtatcgagcaggacgccgatatcgttgcgttcctgtaccgtgatgattactatgacaaagaatctgagaataaaaacatcattgaaatcattattgcaaaacaaaggaacggcccggtcgggaccgtctcactcgcttttgtaaaagaatataataagttcgtcaacctggaacgccggtttgatgacgcgggtgttgcgcctggtgcataaatccctgagacatgttctcagggatttttcttttttcttgcattgcggtttttaccgatttcaaataaacccgtcgctgttaatccggccagtcctcctgaccataaacggagcaccagttcaaggtctgtaaaaggatatgctgcggaaccgatcagcaaacctatcaagagtgaaacgagcggaatcaaatttttcggcattttgaccgtcttcttcaccaattcgaccaaagccaaaatgatcggcgataaaactgatgcaaaaattaataccgtctccatcggcatctccctccttacttattgaatatttgcgttgtcggttttttatgtatctttgtccaagaaaaacggtttttttaagatttgacttacagactgtctattaaaaagaaaatatatgaaattcgctttataataacgaacaaaaatgttcaacgttaaaattaatgttcggatttacaattgactttacgggatgacactgataaactgaatgtgtttgatattgatatcgtttgaaaaggttaacggaggtgcacggatatgtcttcagtagttgttgtaggtacgcagtggggtgacgaaggaaaaggcaaaatcaccgatttcctttccgaaaatgcagaggtaatcgcacggtaccaaggcggaaataacgcaggacatacgattaaattcaacggggtaacgtacaaactgcatttgattccatccggtattttttataaggataaaacgtgtgtgatcggcaacggaatggttgttgatccgaaagcattggtaacggagctggcttatcttcatgagcggaacgtcagcacggacaacttgagaatctccaacagggcccatgtcattctgccgtatcacttaaagcttgatgcggtcgaagaagagcggaaaggggccaataaaatcggcacgacgaaaaaaggaatcggcccggcttatatggataaagccgctcgcgtcggaatccggatcgccgatctgttggacagggacgttttcgaagaaaagctcgcccgcaatttggaagaaaaaaactgtctgctagaaaaaatgtatgatgcggaaggatttaaaatagaagacattttagacgaatactatgagtacggccagcagatcaaacaatatgtctgcgatacgtccgtcgtcttaaacgacgcacttgatgacggccgccgcgtcttattcgaaggggcgcaaggagttatgcttgatatcgaccaagggacatatccgtttgtcacgtcttcaaaccctgtcgccggcggcgtgacgatcggctcaggtgtaggaccgacaaaaatccagcacgtcgttggtgtgtcgaaagcttacacaacgcgtgtcggagacggtccgttcccaacagagctgaacaatgagatcggagaccaaatccgtgaggtcggccgcgaatacggaacaactacaggtcggccgcgccgcgtcggctggtttgacagcgtggttgtccgccatgcccgccgcgtcagcggaattaccgacctttcattaaattcaattgacgtattgaccggtattgaaacattgaaaatctgtgtcgcttacaaataccgcggcgagatcctggaagagttcccggcaagcttaaaagcgctcgctgaatgtgagcctgtctatgaagaaatgccgggttggaccgaagatatcacgggcgcgaaaagcttgagcgacctgcctgaaaatgcccgccattaccttgagcgagtttctcagctgacaggcattccgctttccattttctcagtcggtcctgaccgctctcaaacaaatgtggtgagaagcgtttatcgtccgaactaaattctagaagagcctctgcagtccgcaggggctttgtttttcaatgacaaggagggcaaacgggtggaacgtgtcgatgttgtatattcattcgcggaagagaacggagacattctgatggtgaaaaacaagaaaaatcaatcatggacattgccgggcggcaaggtggaagctggagaatcgctgacgcaagccgcggcgagagaaatgaaggaagaaactggctatggaattcagcctcttgatattttagccgtaaatgaagcggtgatcagcagcgagcatgtatatttcatcgtctttagagcacggatcaccgaccgtccggatgccatcacgtttgacgagaacattgttgaagccaagtgggtgccgcttcatgaagctgaccggctgttgtctgtattccatccgaatggaatcatgcactggctgaaccgcgaaggggcggagtatcatcacgaagggaaaaaataatagaaaaaaataaaaaaatatattgccacttctgttcgttctatgataatataaatctcgttgttgcgaaaacaacgagacgagccattagctcagttggtagagcacgtccgaatacgcttcggagaattcgcttcagcgtacacatcgagagacatcccgaaaaagcttcctgagatgtggacgtcgttattttaagggtgtcatttaatcttgagccattagctcagttggtagagcatctgacttttaatcagagggtcgaaggttcgagtccttcatggctcaccatttccctggcccgttggtcaagtggttaagacaccgccctttcacggcggtaacacgggttcgaatcccgtacgggtcattgatttactttagcgttattgctaaatccccgcttgcttcggaggagaccacgattcttctccgaagcaggtactgtaatcatgcaaggtccggtagttcagttggttagaatgcctgcctgtcacgcaggaggtcgcgggttcgagtcccgtccggaccgccattttataaaaagttacatacatacccggctcggtagctcagttggtagagcaacggactgaaaatccgtgtgtcggcggttcgattccgtcccgagccactctaaaaagcgcgtctgtttttaagcagatgcgttttcttttagctgaaatcaatgaaataaaaatgctgaaggaatgaaaaggagaaaaaaagggaggccggtaacccggccgaagaagaagacgttactatatagacggctttgaagcataaaatgtttcatttttcagtaaaaaaagtcacaaaaatttaattgttgtgataaaagcggaaaaataaagcgtggatttaatttccaaacgttttcctttgaactatttttttaacttttgcttcataaacgttataatgtataagaaatctatttcgatttctagaaagtgtttttttaatgatgacatgcagtgtactttgatataaaacatagacagccatccgctggctgtatccaaactctgaaccaggaggaatgaataatggaaaaaaagatactagttgtagatgatgaaaagccgattgctgatattttagagtttaatctgaaaaaagagggctatgaagtccattgcgcatacgacggcaatgaagcgcttcagatggttgaggatctcaaccctgatatgattctgctcgacatcatgcttccgaataaagacggtgtggaagtgtgccgtgaagtccgcaaaaaatatgatatgcccatcattatgctgacagcaaaggattcggaaatcgataaagtcatcggccttgaactgggcgctgacgattatgtgacaaaaccgttcagcacccgcgaactgctggcgcgtgtcaaagcgaacctgagaagacagaacacagcggctcctgccgaagaagaatcgtcttcaaacgaaattcaaatcggatcgctcgtcatttttccggatgcctatgtcgtttcaaaacgcgacgagacaatcgagctgacacatcgggaattcgaactgctgcattaccttgcaaaacatatcgggcaagtcatgacgcgtgaacatcttctgcaaaccgtgtggggatacgactactttggggatgtccggacagttgacgttacggttagacgccttcgcgaaaaaatcgaggataatccgagtcacccaagctggatcgttacaaggcgcggtgtcggctactatttgagaaatccggaacaggactaatacacaaatgaataaagtaagtttttttcgctcgattcattttaagtttaccttaatatacgttctgctgattatcgtcgccatgcagattatcggcgtctactttgtcaatgagatggagaagtcacttcttaaatcatataatgactctcttgatcagcgggtgaacaacctatcgtattatctggaacaggaaatgacgaaggatagaagcacatcttcctcgtctaccttgaaggaagatgcagagcggattctaaatgatttcagcaaagaaggagaaattctcgaagtcagtctgattgataaaagctatgaagtcatcgcgacctccaatccttataaccgggaggtggcggggaaaaagacaacagagggcattatcaaaaggacgctgcttgtcggcattccatacgaaaataaatttttcgacccggagcgggacagcaaagtgcggatttcggtcacaccgattaaaaaatcgaatcaagagacaatcggggccatttacgtcgtggcatcgatggataatgtctacaatcaaatccggacgatcaacaccattttagcgtctggaacttttattgcgcttggaatcactgcttttctcgggatttttgtcgcgcgaacgattacacatccgctgtcagatatgagaaaacaggccattgaactggcgaaaggaaatttctcaagaaaagtcaggaagtacggaaacgacgaaatcggccagctggccacaacgtttaattatttaacaagagagctgaaagaagctcagtccatgacagaaggcgaacgaaaaaaactatcttctgttattgcgtatatgacagacggagttatcgcgactaaccgaaatggcgcgattattttgcttaatacgccggcgctggagcttctaaatgtttcacgtgaaacggctcttgaaatgccgatcacttcgctgctcggccttgaagacgaatacacgtttgaagatttggttgaacagcaggattccctgcttcttgaaattgaacaggaagaacggacgtctgtgctccgcgtcaatttctcggtcatccaaaaagaacacggaaagatcgacggattgattgcggtcatttacgatgtcacagaacaagagcagatcgatcaagagcggagagagtttgttgcaaatgtctcccacgagctcagaacgccgctcacaacgatgcgcagctacctagaagcgcttgcggaaggggcatggcaggatccaaacattgcgccgcgcttcttgaatgtgacacagaatgaaacagagcgcatgatcaggcttgtcaacgacctgctgcagctttcaaagtttgatagcaaagattatcaattcaataaagaatggattcattttatccgtttcttctcattgattattgaacgctttgaaatgacgaaagagcagcatgttgagtttatcagcaatctgccggatagagaattgtatgttgaaatcgatccggacaagattacgcaagtgctggataatatcatttcaaatgcattgaaatattcccctgaaggaggccatatcacgttctctgttgatgtaaatgaagaagaagagcttctttatgtcagtgtcaaagacgaaggtgtcggcattccgagaaaagacgtggagaagatcttcgagcggttctaccgtgtagataaagccagaacaagaagactcggcggtacgggactcggtcttgcgatcgcaaaagaaatggtacaagcccatggcggcgacatctgggccgacagcatcgaaggaaaaggaacaacgatcacatttaccctgccgtataaagaagaacaagaggatgattgggatgaagcgtgaaacaattaaaacgataatactgtcccttttggttttgatcagtcttctttttacttttaatatttggggatttcaggggaattacgaaaaagttgaagactcacaggctcaggtcagcgacaaacagccgattacaaaccagacaaagttgttaaatgaagccgtcaaaccgcagcaaatgttcattcatgagaatggacagcattatttgctgaatgacacgacgctctattctcagctctgggatgacatgggacgatgggaagtcaaatcgttaaaggatatctcggacaaatttgacaggcagcagttcaaaaactggctatacgctaaaaataaagactccaaattggatctcgtcttcagcgacaacattccgatcgatgtgctgcagccgcttttcaaatggtccgccaattcttatgaatacaactcttttgacagaatcgttcttcctttcaatgaaggacggggcatgaaggagatctattttgtatccttcagcaaagagacggttgttgaagcggtgattgaatcggcaaattaccgcaacatcctttcagacattgaaaaagaaaagtcgcagatgcctctttatgaggattttgcaatcaattcgcgcagagatgtcttgcttccggttaatcggctgaagctgtctgaaaaagagtattttacagaaacgatcagcccgacgcgttttaaaaaagctttatttgatgatccgcaaaccgtgcggcaggaaaccaacttaaacagaccggtatatacggatggaacaagccttttggagatctactcgaacaacagacagattaagttccagcaccgcaacctggaaccgagtacttcttatcaaaatggagagctgatcaataaaagcttcaaatatttaaacgacacgggaagctggacggatgattatcaatttttcggtttgaatgaaaatcagcagatcaactttaatctgtttatggatcagctgccggtcgttaacagccaaaaccagcctttcggaacgacatcgattgaacttcgctgggcaaacaacgacatattggactataaacacccgacatatgtcttgggcgcaaacgcaaatccggtcagcaaaaaggataaagaaatcatgagcggagaagaattgattcagttcctgcaagacaatgaagagtatgactttgataagattgagcaaattttccccgcctatgaaatggtctcagtatcagaggaacaagaccctcttgtcaaacttgtgccgacatggtgcattaaaataaacggtacggtaaagccggtatcaaagaaggattcagcggtgaaggagggcatagaaaatggagtggaatagaacaaaaacaatcttcattatcgtcttcctcatccttgatatctttttggcctttcaatactttgataagcgcagcaacaatcagtttccgattttagaaaaatcaacgctgcaggaggatatgaaagcagaccatatttcatacggcaatttgtctaaagagacgtcaaaaggctcctcaatctctgcacaaaagcgagtctttaagcaaagcgagattaaatcgttaaaagggcaaaagccgaaggcgttaatgaataccgcaaaagagaacgctttgacagaaatagaaatggagtttgaaacacccattgcgcttccgaaaacggatatgaagacaaaagcaagggaaatcgtgaatgaagagattatcgacggcaataagtacaagctttggaaggtcgataagtccggaaaacagatcgttttcttccaaacctataatgggaattacatttttcaggaccggcaaaatgatgataacaacgagatgggcgaagtcgttctgtacctgaataataaaaacgaagtcgtgtcttataagcagtcaatgctgcaggatattaaagaagtcaaaacggaaaatctgatctctgcagtcggcgcggttgaagctttgtactacccggattatttgaagaagtacagcaaaattaaatcagccgagcttggctatttcacgcagtatccgctggcaagcgctcaaattttcgtgcccgtttggcggatcgaagtggagcgcaaaacggacgataaaaccattcacgaagaatttatcgtggatgcacgggacggagcgcttcttcaatcacaagagaaaaaggaaaaatcataatggagtgagaaaccatgagcctgcaatttagcgtacttgcgagcgggagtaccggtaatgctttatatttggaaaccgatgaccacgcttttttagttgacgcaggacttagcgggaaggcgatggaagggctgatggcgcaaattgatcgaaagcttgatcagctcgacggcatctttgttacacatgagcacagtgaccatataaaagggcttggcgtgctggcaagaaaatatgagctgcccgtttacgccaatgaaaaaacgtggaaggcgatggaagggcatatcggcaaaatggataacggccaaaagttcgtttttccaatggaaaccgtcaagtcattcggctcccttgatgtcgaatcgttcggggtatcccatgatgccgcagagccgatgttttacgtttttcattacaatggccgaaagctcgctttgattacggatacgggctatgtcagcgacagaatgaaaggcatcatccgctcggcaaacgcttttgtttttgaaagcaatcatgatgtcggcatgctgcaaatgggccgctatccgtggaacatcaagcgccggattctaagcgacgtcggacacgtatccaatgaggacgcggcactcgcaatgaccgatgtaatcggcgatgagacatcgagaatttatttggctcatttaagccaggacaacaacatgaaagagctggcaagaatgtctgtgcagcaaacgctggctgccaaaggatttgcggcaggagaaacgtttgacttatatgataccgatcctaagaaaccgacgcctctcgtagcggtgtaaattttcctgattgaatgattaatctgcaggcagatgatccacactatatacatatatcgttccttgaaaggatttgaatatagtggagtttaatcatgatgaggaaaaattcgttcgggaaaagccggtgagaagttggagaagctttttgttttcaagcctggtcggcgccgtcatcggcgctcttttaacagtgtttgccttgccgtatctctcgcagcagggatggctgccgtataatctgcaagtcatcgaagcgcgcggcggccaaggagcacagcagggcgggacggtccgcaatgtatccgtcaacgtgaataatgaagtcacgcaagtggtctctaaggtttctgattctgttgtcggcgttatcaacatccaaaagacaggtgtatgggatggtgacagcgaagcgggaacaggctcgggcgttatttataaaaaggacggcaacacatcccacattgtgacaaaccaccatgtcattgaaggggcgtcccaaatagaaatcagcctgaatgacggaacacggattccggcaaaactgatcggcagcgataagctgatggatctggccgtcctgcaagtcaacagcaacaaaataaaagcagctgccgaatttggagattctgataaagtgaagacaggcgagcctgtcatcgcgattggaaacccgctcggcctgcagttttcaggatctgttacacaaggaatcatctcaggaaccgaacgcgctgttccggtcgattccaacggagacggacagccggactggaacgccgaagtactgcagacggatgctgccattaacccgggtaacagcggaggcgggctgtttaatattgatggaaaagtcatcggcattaattcgatgaaaatcgctgaatcagccgtcgaaggcatcggtctgagcattccggccaaccttgccattccggttatcgaagatttggaaacgtacggtgaagtgagacggccgtatctcggaattgagatgaaatcacttggcgatatcgcaagctatcactggcaggaaacgcttaaactgccgaaaaacgtaacatcaggcgtagttgtgatgggtgttcagccggtatctcctgcaggcagagccggtctgaaagagctcgatgtcatcgtcgaatttaacggtgaccgtgtttacgatatcgttgatctgcgtaaaaagctttacaccaaaaacgtcggcgacaaggtaaaaatcaaatacctgcggggcggaaaagaaaagacaacagaagtaaagctgacccgatcccaattaggaagctgataaagacagtctggccggtacggccgggctgtttttttattatgaagcgcccaacgaatgatcgtcaaaaggaaaaaatgtgatttttggagagtgaaatgagattttttctgagtgaataatcgaatttttgggtgtgaattccaagtttttgccctgcaaaaattatagtttgtaaaaaatggacaaagcatcatattgcgtttcaattttgcgtacgatatgatgactttaatattctgacaaatggccgatttaatgcaggatttaaagatcagggcggaaagggagataggatgagtcagcatgcacttgtattacaatctgattttggccttgatgacggggcggtaaatgcgatgtacggtgtggcttattcggttgacagttcaattcggatttttgatttgacgcacaacattcccgtttttcacatttgggaagcttcctatcggctgctgcagtccgtttcttattggcctgaaggcactgtcttcgtgtcggtcgtcgatccaggggtcggctcagaacgccgcagcgtcgcagtcagaacctcttccaatcaatatatcatcacaccagacaacggaacactcacccacatcagccggcaaaatggaattgccgaggcgcgctatcttgatgaagcgcaaaacaggcttccaaaatcaggcgaatcacatacattccatggacgcgacatttacgcctacaccggggcaatactggcagccggcgctctcagcttcgacaggatcggtccggaagtttctatagattccatcgtcaaactgccggtcttggaagcgtacatcgaaaatgattggataaccggaacgatcgatattttagatgtccggtttggaaacctttggacgaatatcagccggacgctcttcaagtcacttgatgttcaatacggagatccagtagaagtcgtcatcaagcatgaagacacaaaagtctatcagcaaacgttggcatttggccggtcgtttgccgatatgcctgtaggcaagccggttgtttatatcaattcattagaccgcttgggcattgccctcaaccaaggatcatttgctaaaacataccatattggcacaggcatcaactggcggatttctcttcgaaaaagtatatagcgttagacaaaagagcctgattttccagtcaggctcttgcttttgtgtcattcttatgacataaaaacggttgtcacacatttttcagctaatcgtgaagacagcaacctcttcaaaaatggttcttttgtcacattggtacctaagtcatattgtctaaaacaagagaaaagaatatattgagggggtgtgccgctgctatgaaaaaattcattcaattcatttgtttggaaaacgagtgtccggaggaatgatatgaacgacaatgtgcaggctgcgttgaaaacgctgtctaatgtaaagagcagaagtatcttgtccgtttttgtgctatgtctgatcacactgggggtttacataccatactggtttctatccaggaaaaaaagcttcgatttgctgccttatcatgatattccctacaccacgttaaaagctatcatattttatcatttattttctattccaattagaatatcagcaaaaatcgcttttcctgacatgcattacagcctttatatgctgctcgaccgcgtgattttgattctgtccgcaggtgttttgatatactgcgcactggtggtgactgcttcattaaacaagctttcaggcaaagaacctgcgaatggatcgatttttgccttccttttgaatatcatttacattcagcacagaatcaataaactttccgagccgaaaagcgaatggctgagcaaagcatcatgatctataaacaaggaagtgaagtacaatttgatgttgaaatcgaaaattaaaattgacttgaacaaaccgagaaaaaagccggaaatccgtttgacgccaatgacggaagaggactttaagatataccagacctattccatccagcattacgccatggagaaagtaaaagcgggcacatggacagtggcggaagcgatggagaaagcagaagagcagtttgcggcccttttgccaaacggcattgaaacgatcaaccattatctatggtcaatcatgaacgacagcgggaacgccgcaggctgggtttggatctacgctgatccgcaccaccctcaaaaggaagcgtttatttacgatttcgggctttatgaagcgtaccgcggccagggaatcggccagcaggctttagccgtcttagaagaggaggcaaagcaattaggagtcaaaaagctgtccctgcatgtattcgcccataataaaaaagcgaagcgactatatgaaaaaatgaatttcgagacgacagatttgcatatgagcaagagactgtaagatcaaagctgtgaaagctttgatcttttttcatatccaatgttccacatggaacatagcgtgtcattattcctagttgagagatacgaaaaataacgaaaaaaagacaaaatgattcgatagaacccctttatgttgcgtaatgacagattgcatattacaaaggtaaaaatatgacgaataatgtcctattgattgtcgaatttctgcagatgaacacgaaataaggaacgggcaaaaggatatagtttttttattctagtcaaaaaaaagaatccatatacctaagaaaatcccaatttaacacttcaatggattttgatttattggattcaatatagtacattttgatatggaaagtggaaaagtatagatgacaaggataaaaagacctggaagaacagttttaaggaaagaagagtgtttcagcatgagtaaggaattagaggaatttccgaaaataaaacccttatatgcggtgttattaacgatcataacgtccggcatatacatcccgtattggtttctctcaagaagaaagaatttagaacgatgccaaattaagctcccgtatgtcgccattaaagtgacgctgctgttaagcgtcttttcaattttggagcctttttggactttttattcaatcacatttcaaagtgaagacctgctgccatacagcaacagcattttgcttctcccgctgcgccccggacacagctttctcccgcagctctcattcctccttttttggacggtaaatttatatagtgcatttaaggttagaaaagcgtttattgggctgtcggaaaagcaggttaacgggttttggactttcattcttaacgtttcatatttgcagtatattacaaatcagcattctttagttgttcaggaaaaaagagaagcagtataaaaacaagattaaagcatcagcgagattggctggtgttttttatttggagagaacagagttatccagaggaatataaaagcttgtggataaccgcgtgaagtcatgctaaaacctactaacatgtgcataaatagggtatattgaataaggagcttttttataaaagagcccaatgatacagatattggagggacttttatgaagtcttgcgaagagcatattgaaacggtcattgacatgtatgtggatgaggaagaattggccccggaaatcagaaaaatcgaacatacacacagtttatccacaacctgtgaattgtgtgataagcctgcagtatatatagtggggaacgaatgatcggacactaaatacacaacctttatccacaattgtggataatgcatctgaataacttgttcttaaagtggggatgacctgtgaatatatcaatcgtagcaatcggaaaactaaaagaaaaatatttaaaacaaggaatcgatgaatacataaaacggctttcggcatacgcaaaagtcgacatcatcgaacttccggacgaaaaagcaccggaaaacctaagcgaccaggacatgaaaatcgtcaaagacaaagaaggcgaacgaattctctccaaaatcagcccagacgcccacgtcatcgccctggcgatcgaaggaaaaatgaaaagttcggaagaattagccgataatatggatagactcgccacatatggaaagagcaaggtaaccttcgtcatcggcggctcgctcggcttaagcgacgccgtcctgaagcgcgcagatgagaagctgtcgttttcacggatgacatttccgcatcagctgatgaggctgattttgctcgagcaggtttatcgggcttttaggattaatcgaggggagccttatcataaatgatggaaaattttaatttgaacttatccatattaccttaagaataggagaaacacacaattactcaggagacaagcaattaggcttgtctttttttacacctctcaaatgcaaatagaaaatccccaacaatttgctacattaagaatacattaaaacagtctacaattttctgaatcggttaagcatttaaaggaagatgggaatttaagttttcatttttatataacaaaaagggaaaataatctaaatatccattctgataccctctaagagttttatacattagcaaatctaatacattttgaccaaaatttttaaaaaatcaggaaacctcttgaatcagttttgttttacaattattataaaattagttaatttgagttaaagagagttggtgttagggtccccggacccaaataaaaactgcttttgtcatatggattcttcgtttatttgctctcatttaggtatcttgtttgatttgtttctttggcaggatgttttcaggactatagtgtttggcatccgcagtagttgtttggcgtttcacctgttttgtctctatattatccaggacactgtcccaaatcatccggaagcttctgctgttattcttttctaggccaaatcatatgccttcaacaccgacttgtgaattataggctttttgagacaggatatgggacgctaatcatcagtaaaattgatttgatctttgtagcgttggctatttttcttcaggtgtgcgttcttccagttcttgtaatgccgcgttggcttttgcaagccgatttctacgatattgaattttgcggcggatcgtcttcgggaaaagagagagcagtccttcatctttgacatccgcttctttgacttcttccaccatctgcttgacctctttttcgaaacgctgagattaccattttatctgcttacataacgatttatctgttttgcgtgaacaattttggaacacatccagattgcttttccgaaaatcgctgatagtgcgaaaaccacgacgctccccttttacaaccagtgaacagatttaaggatagccgtctgaattttccggaagctgaaacacccgtgatatatataaccataaattaaacagcataggcggattgtacgagttcctccacattcggagtatttctgaatgatagagccacacggtccacgttctcactggctaaccggatcaaatgatcttcaggagtcagcataatacatccagttcaggtagataagatttgaatttggtgacttgcttttgttcttcttctttcattttctgactaatccaaactggaaaaagcaggtcttttaacagattaggaggtttctgacatgcaccattcggtcactaaccgaatgcagtaaaggacactgtggtgcttgccagccattagggtattgaggaggtgatcaaaatgctaggtgacagtatttcgtcgaagtggacaagtcgtgaccaaatgacctcggatcgagggttggtcatggaggaaaaaattgatgtctggtgacaaagaggagtcatgatcatggcaccgccaacgagggaaaaaactcttcccgcatcgacacggtatgtgggcggtgacaaactaacttatagagtaaatttattagtcgaatgaaagaggaggaatgaaataatgaaaaatcatttgtatgagaaaaaaaagaggaaacctttgactcggacaattaaagcgacgctcgccgtgttgacaatgtccatcgctttggtgggaggcgctacggtgccttcatttgcatgggtgaatccgggttatcactaccagtacccatcggaaggtggtacatggaggtatggattcgtaaacgccgggctccgttcagagtacaaccacccgacaaaggtccacggctcgacagtgcaaaagctcatcgatggaaaagtggataaaacgaatagaagtattgatacggctgcgggccgctactctaatgcctatgtcggagccataaactcacctggtcttaagggtcgttactactatcgcaccaactaatcaaagggaaaacggttgctgtcaacggggctagcatggcaagacccagaaaagttctgggagatcccgctttgcataagcgtattatagtggatgacgcgggctttgttgtttacacttcttgcacctgctgacggcaatcatccctatctatgaaatcgagatttcagcaggccgttattttcgagagagttaaatctatattcattgtttttattttggtaaggacataccggattttaggtttggattaccggtcgagttagcttgtcttttcgcccactaccgtgtcgatgcgggagcaatttaccagaagcacttaccgattgatagttttttattccggtgattgcaaagtttcataaactctgagaattcaataggggtaataccccgctttgaggggcgcggcattttatgcgccccgagtatttattcttaaaatttttaaattaatgtatctatataaaaaggagatgctttcggtgtactgccaaagcatctccacaaaagatagtgcatatctgcaggaaaaaacataaaatgcaactaacatttttggaaagcaataggtttatttaattttgtagttttatcttggtagccttagcagtaagttattttatgcggtgcaatcctctacttttccaggtttagtgttgatgccggccgttattcagcaaatttgacaagaaacaaattctttgtgccccggcagtcaataggttacttatggtacaacaagtgaaatttgctagttgtaaaaggaattaatgtttgtgacgaagaagagatagtatgtcacgacactgtctacaagagagaaaaaaacgttcccctattaatgtggtaggtgggtgatgattaatcggcttgaagagtaaaaatagttaagtaaatgaggaggaatggaataaatgagtgccgctttttatagcgtagaatttgatgggaggtacagatgttgattgaagcacagggcatttcagtagcaattggtgggcggaccgtgcttgatggtgagaccgttcagtgcccgccaggggtcatgacagccctcgttggtccaagcggatgtggaaagactacacttttgcactgcctcgggctattgctcccggttaatcagggacgcatcttgatagacggacacgatgtcacaagctacggtactgcggcgcggcggcggttttggcgtgatcatgcggcgttcattcttcaggattacggcattatggatgaggagtcggtggcattcaatgtcaccatgcaggcgagcatccttgggcggcgtgtcacgggaaaccaagagcggttggcgcaggtgctcgagcagacgggtctccagggtcgagaaggtgagttggctagccaccttagtgggggcgagaagcagcgactcgcactggctcgtgccatctacaaggacgctgcattcttgtttgtcgatgagccgaccgcctcgcttgactcaaccaatcggcgaaaggttatcgatctgtttgcggacttcgctgcgcgtggccgcacggttattgtgtctacgcacgactctgagatgatcaacgcgtgtggtgctcggcataaggtcggttccagcagttcgtcaaaaccattgtcgaccaacgatcccggcaacttaggaggtaactcatgaaatcaaccacgaagatcattatcggtgtcgtcataggattattgcttgcagttggaacaattgcattcctaaacggatggatcacagtgtcaagagacactcatccgccgtgcgatcagctgccgaacgtaacagaggccaatgcagcgctttccagacatcaagacctcgtcgaggagattaaagctttgggtgatgacattacggtcgaagtaggaaagccgtgtcctgatgacgagaaccgagggctggtcatggttagctatggttcaagatccgagcatgacgcaatctccgacctgctcagccgccgtgacgggtttggggtcccagtgcacctggtgaagcgctaactcaacttctacacaattcactcggtgtaatcgtttcctgctgtttacggcaagactggctccccgtttttgtcaagcagtatgaacctgatgcagaccaactacgccaagcaagaggcgctggctaggctttacatatgagcccttggaggattgattggaggcagagacaaacgagttgaggagtagaaatattgacaaaaatagttgaataaatgaggaggaatgaaatgaagggggaacattatctgttaatccaggcaattacgccagtccccggcgataccggttgtgttcgccggggcttagcatggcaattttcaaatagttcttggaggtccagcttgtgtataaacgtattatagtggctgtcgcgggcgcgttgtttgctctgcttgcgctactggcggcgattatcaccgacctatatgatcgagactttcctcaggcgattggtgccgagagcaggttaaaccttgatttcagcgaatcggggctttctattactgaagcgtttgcgaagctggagaagctcgatgcacgctggaatcttgggctggtcaaggttgcgccagaccttgcaagcgacggcgatggccaggtctacgtagcacttaacgatagagatctgcccgacgaatttacttggtttggcggcgatggtgcaggcaagattgtcggtaaggaccggcttgaaacctcctaccccgatgggttctatctcgtgaccggtgaaaaggctcacttgagcgagtttgaggacacgctgaaaagtgaaggcgtgaaggtcggtcgcggggatgcgtccatttttaaaagccttgaattcgttgtgcgagaaagaggatttgctgccgctgttcttgcagcatttgcgctgattgcggcgcttgcgttgttctggttgtcgttaagagcgcgtgggcgtgctcttcgggttctgggcgggtgcccgacctcgcggattcaggttcaggacctggccgggttcgggggggcgctgctggtttcggcggtggctgtagcactggttgcgtcttgctacgtaggtttgtttcatggctggatatatgtcggtaccttcctcaaggcgctgttcagtctgcaggtcgctgttattaccgtatccctgttggctacgctgatcatgtcagcttccgcatggcctagcgctaccatgatcgccaccagacaacctgctgttaaaagcttgcgttcagctgccatcgtgatccaggcgttaacgttcctcctggtggtagctgcggctggacctgcttggtccgcatacaaacattcctcagctatagctgctgaaatggctcagtggaagaaactcgcagatcaagttgcgattgtgtttgcgacagacgttgacgagatgaaccacatggagccgcagattggtaaactggtaaaggatgcggaatcgcttgataaggtagctttttcctacacatatactcaagaaatgccaatgccagccgattttggagagtactcggccatctcttacgtgaaccagcgttggcttgatatggtgaccatggatgcaccacagcctgctgttacaaaggtgccttatcatagcattccaaaagggcttgtcaaaatgattcgagaagaggccgagcttttgtcgaggaaagagctttccgatgagcagttcggtaagttcaagttcttgcggccgatcgacggattccggttgccggtagcccaaggaggaggaggggaaagacttcactttgcggacgatgtcctagttgttgtcgtgccctcgctctacgatacttataacgattctgctttgacttccatggtctcaggtagcaacatcgtattcactggtgtaactgctacgcaggaattgttagggaaacacggccttgacgtgaaggcactgcgtgatcgagatatcaacggtgaactgaaagttgtctatgttgccgaagaggggattctccgcgcgcagttcgcagcgtacgttgtatggttgttgaatcttgcgctgattgcattagttattgctttcactgtcgctgctgcgattagtgcattgataaccgcgctgctgcaggcgaagcgtgactttccgctgcgggtggcaggccagtcatgggtacggattctccggagccgtgtagccaaagaaatgcttgttggggtcggccttgtgggcgttgttgttttgctccaaaggcctgatgagataggggctgtactagtggccgcggtgtatgggttgcttgttgtgccgctgagtcatctgtttgctgtacgttggtgttttgatagagccagcaaacggcgaatttgaccggaggtaagatgtcggatgaagcccagggcgtttcagtacaattggcggtcggtccgtgcttgacgtcacggaccgttcgtctttcgcccgggatcatgacggcaccctggttggtccgagcgaaataattttcgattagttatacggtgattattacagataggaaagagaaatttctgaatagtatttttaatcaaaagcttataaatgaagaagctgaatattgtcaatcgtttcaagaaggactaataaaaatagttgaagaaaatggttgtattgatttcgaaaaggagaggagaagacagagcttaatcatattaagagtatgtataagataagccgttgatatgtcaacacaggtacgagattttagtaaggtagtttctaaatggattgaatgggataccgagtatgcatatgagtattggactccaatcaaacaaggtatatcactgagtgatacagagaaaagagcgacattgaacaaccaaaagaatattctggtgaattaatcgactaaggaaatacctcttaaaacaggagtgtgaatgttaaaaggagttagttgataagctataaggccaatgtcaaagctcctaaaataccattgtaccatgatggctgcttatctcaagaccccactcaaatccatcctttcccctccgcaatccttgccgcttccatccggtttttcgcatccagcttctgcataatctcagaaatataattccggacggtccctgacgacaagaaaagctcctcagaaatttcttttgtcgtctttccgatatatgccagtcgcaagatgtcctgttcgcgttcggtgagcgggtttgtttcgcggacagcgttgaaggtaagttccggactaaaggttcttttgccttccgtgcattttcggatggcgtctgcgagatcgtcgatttccccgtccttgagcaggtagccgtggacattgcttttgacggcgcgttcgaagtagccgggacgcgcaaacgtcgttaggatgatgattttcgtttttgcgccttgctttgcgagctcttcggccacttccagtccgcttttgaccggcatttcgatatccatgaggcagacgtccggttctagcttcagaatggcggtgagcgcttcttcgccgtttgtcgcctggccgatcacttccatgtcttcttcaagatcaagcaaggatcccagcgcgcttaacagcattctttggtcttcggcaataaataaacgaatcattggattgcttcctttccttcagctttctttacatttggaacggcgatgcttaaaactgtgccgtcatgggttgaaacgtcgagagcgccgtcgattaatgcaagtctttccttcattccgcgcaagccgttaccaaatggtgttttttgctgatccatccccattccgtcgtctttgatggtaatgcttattttatcatctgtttgagagatggaaatggtgcaatgggtggcgcggctgtgtttgacgatatttgtggcggcttcgcgtatacacatgctgacaatgttttgtgtgacaggagggatatttgaaaaatcggaacctcccatgtattcgaatgtgatgtctgcagcccgcaggatttgctggatgtggatgagctcttctgcaatagttgccgttttcatatcagacacgagttcccggacttgttttaaggctgctcttgatgtggtttccatttctcttgcttcttttcgcgcccgttcgggggcgctggcgatgatgcgctggacaagctggctttttaatgtgagcagtgaaagagtatggccaagtgtatcgtgcagatcgcgggcaattcgtacacgctcctcgcgcttgaccagttccttaatatgctgatttgcttcatcaagcttttgttccagttccatgcggcggttcatggagcggatgccgtatggtgaaatgagcataatcacaagaaagggcagaaaataaaagagccgattaagcagggatggatctttcagcagatgatagataaaaggggcgaccaatacaacaaccaggctggcaaggccgcaccggaacgtctttttttcccggtaatagccgataaagttcgctgaaaaaaagcctaaaaatactaagttgatatcataaaatacagtgtagattaaaatgattgaaagctggatggccagccaataagtaaataattttttttgcggcggaataaaaaaaagctggcggtacgtcaccaagaaaagcagcacgagtccaaaaccgatcagctgtttgattcccgaggtctgatttgtcaaataagaaatgggcagcagtaaatagattaaaaagatataaggaaaaaagccgtaccgtttcggaaacatgctgaagttttttttcattcttgttcacaccgcttcttgttttcttcttatatatttagatagtagcataataacgattgaataggctaataggaagagaatatttttccagtttggcatttgacctcgagcgatttcccaggcgccgctgccataatgataggacggcagccaatggccgatattctgcatcatttttggcataatttcaagcggcatccacatccctccgcatacggcgagccccatatacagcacattgctgattccggctgctgtatccacttttttcatcatcccgatcaatgtcccgatcgccagaaacgggagcgagccaagcagggcccacaatccgcacaggaaccattccaatggggataaagaaacgccgttgatcaaggcgccggctaagaagattactgtgatcgaaagaatatgaatgacgctttgccccgacatttgagcgataaaataaatgtggtcgggaagaggcgttacgcgtatgaacgtcgaccagccttgggtgcgttcttgaaccatgcggatgccgagtgatcgaagagcccatgacgctgaatgttgtcatcgacattaaataatgcgcattccatgccgcagggtctggagcattcgtattgacgacatttgtaaaaatataataaaaagcaatcggcatggccaatgaccaaaagacaaaatagcggtttcgaagcattcttttgatttccattctgcactgcatctgaaatacattcattttactcgtctcctttgcttgtcagctggcgaaatgcctcttcgagatttccgcgctcaatttgaatatcataagcgccgatcttttctgagaaaatgagttccagtattttgtccgtattggccgtgtcgatgtaaacccggttgtttttacgaaaaatctgttcggtttctgggtgctgatacagcttctcgagtgactgttccggatcaactataaatgaaaccgaatgcttcgatattcttgattttatttggagcggcgttccatcagctactatcttgccgtctttaaacagcaagattcgttgcgcggcatcatctgcttcctgtaagtagtgtgtagaaaaaatgatcgtttttccttgctctgcgagcgattgaaccgtttgccaaaagcggtttcttgaagtgatatccatgccgaccgtgggttcgtcaaagatcatcagttctggatcgccggcaagtgccaaggcaaagcctagacgccgcttttgcccgccggacaacttttctgcctgtgtttttaaatccttgtctgtcaaacctgtcaacgttctaagcttttgaaaggatagaggctttggatagtagctccggatgagttcgatgatttcacctgcacgcaaaccaggcatgacgctgacttcctggagcatcgtgccgattttttcacgcacccgtttttcatgcggcatggaatcgaataatgtgatgttgccagccgtcggttttaacagccccaatatcattgaaatcgttgttgttttcccggctccgtttggccctagaatggctacaatttctccttttttaattgaaaaatctatctgatcaaccgccgttttttggcggaatgtctttgtcacattcgtcaagcttacaacattgctcatggctacaggccacctcctgatttactcatttcattgtataagttgagggaggcggattttagtaagtgatgtcatgaaaatcggatgacaaatgtcattttttcaaaaataacagggagccagcgaacggtgcagaaagaatcaaagggtgttaaagcatatgaagtggaggggttacggtaagataacaaagcaggatgccataataaccaacgcatcatggagatagagagagcggtcttcaattgtgaaagaagctctctctacttaaaaggagattcttaaccattatgatgaaccggatacttcctcccattcttcacaatcttctcttccacaatctctttcacgtccaatccaagatcgttgcacagcatgaaagagtagatcaaaatatctgcgatttcttcacggatgttttctttatttgctttgagtgcttcttcactgctgatccattggaagtcttcgagcagctctgctgcttcgatggaaattgagatggcgaggtcttttgggttatggtattgcctccagtttcgttcatctctgaattcgttgattgcgttgatcaggctttggatatcgttcatgaccattttcccctttctaactcgagtagtctcttttttaatttaggatctgtcgcataaatatagaggccttgtatgccccgcttcatcaggacatttattgaatttaggatgatttgttctttaatttgttcattctgttctggagacaaatctgtacgtaacacgaatgcccctgtatctttgtatttggaagtatcaattaccagttcgtctttttcttcatcatagcttacggaagggccgagaacgacgccgacgtaatttaaatcaaacccttgaacggtataaatggagccgacttctttaatagaattcggattttccgcccatgtcactttatcttgggtgctgttccagggcatgttaatcccttcttcatcaacgatgtaagtctttttatcttttttatgtaaataatcaaaggtcgagacaatccgggagagaccgtcttcactgtttttgcgttcaatagctgttttaaacgcagcagcatcttcaaatattttaagctcgaaggaggagtcttcagtcggaaagggaagaactttcttttcaacaaagctgtcaatccacttgattgtttctggattggcgttcattctcatttggtctgtcagttttacggttttcgcatcatactgattaatgatttcctcgagcaatctttcgttccaataacttttaatctttaagacttgttttgggtcaaagatcaccacagtgattttacttcgcttaatgatttcatccagctggttttggtagcggaaatggttataggaatcttcctttgtcagaagcaggtgagcttcatctactaatacgatatccgctgttgctcccgtcttggtcttctcattaataaatggtgtcggcttcatgaaactctttttctttaaattcggtaagctgttggcgatgctcttataagtcttcagcatttcgctgtgatttaccagcaagtaattatctgtttctttcaaaaaagagtcttcactcttagccaaatcttgaatcgtattaaacagagagcttaacaggacacttttacctgtgccggcatctccttcaataacaatgacatgatttccttctttttgtatacgttctttacagaaatcaaggatcttatttttaatatcaagctgctgaggcgagagctctttataaggagataacttataaatgtctttattcctaaggttttcaagagaatcgttcacaattttctcttttctcagcttctcccaaatgacttgaaagatattttcattataaaagggtttctgatagtaattgtgcatttccctagacctggtctggcttacgttttgcagctggtagcggttatcggcgataaaatagttaattaaatttgattcaatattgtatgtcgcagacttatgaaatttctcatggccgattaaaataaagcgattcaaactctttcgcttttcatcatctatatgatttttcaaacgccgtgcagcttgaaccgtttgtccaatatatgcagtcggtttctttttctcgttataaaggatataaacaatcggatagttatttatatgcattgcttttacaacattcacatggtcttgagtaaattctctcttttcaaacacaagttcattcattgtttcagcctctgaatctcttttttaaaataatagtaccatatttatgataaattaatctaaattttaacaaacaggaagctttctgagggcatattgcatagaaaggagggggacatcaatcttatattgacgcaatattccttcaaggatataatatggaaatcatttaaggggggatggcatggtgtttaaaaaaccaaaagttttcatagcagcggttatcttagctctcagcagctttgcggggacggctgcatatgcgcaatcaggctactttaatacgtataccgattatgtttccatgtctaagtcggggtatttcacggcgatgcaggggatgtgcgtcgaccgcaataacaatgtgatctacgctgcaaaattgaataacacgaatcacacgacgcagttattctctgtgaaaatgagcggtacggcaagcaatagaaccgttgcacttcttaaaaattcggataccaatactacgagctatgatttagggcacgccaatgacttggctgtcaaagcatctgcgggcgataaaagcgtcagcgtttatgtggcgccgatgtctgacggcactaagtatgccaataaaatcgtgaagctcagcgtcgatacaacgaaaaatacttataaagtggctaaaacatatgtgctgaattatcaaggttcgaatttgtcgattggcggtatcacatactcggttgggacggataaatttatcgtaagatcgggaaaaaggttctttattgggacattcaatgatacaaccggaaaattcgactatgaagcaacgtttaaattaaactattcgaaagctgttgtgaatcatcagacaatggatgtttcgcatttcattcagcaaggaatttccttttaccaggggacattgtatgtgccgcttacaaaaccggacagcaatggcaatgcttcaaatgtgagcattatattgacgtaccctttaaatatcaatgaaatgattaaagagcaaaaaacaaacccgattcaggacttttcgaaggaattgtttactcgcagcgatttatctttcagaattaccagcagtgcatacacgctttttgaaatagaggctgtcgattttgatgacgggacgctttactttaatacgaatcgcggaaaaagcggaacgcaaaacgatatgatcgcgacatttaatgattataattattataagtaaatgacgtgttgttaggtgcaagggggcggtctcttgcgccgtttttgttacgcgaagggaggtcaatatgtatttttcggcaaagaaaaaaataagaggctggaaaagactgaaacgaagaatagaatggtggaaatcagacaatattcaattgaatatggaatatttaagagatcatcatagagattacgttaaattatggatatcccctttttacgggcttcaaacagtgactcctccattatggtataaacgcttgcttttggaggcgatgatcgatgtctatcatgaatggcataagcaattgaaagctgaaaatgaagatttctacttgaaaatttggttgtatgagcctgattttatccgttcacaaattgtggctgcttataaagaagcgattgatttttacagtggttctttcgacaagcaagaagaaaaagaagcgttctctttgaaaatatacgaacctttagaacatgagctgaatgcatttgaatgggaacctcatattcataccgtgtattaccggctatctgatctggaggaggacctcgaactaggattgagaagcagcggcgatgtgctgcgcataaaagaaatgtcctattcaaaagataatgacggaaaagatgagtggtataaagtgagcgcaggaactgtatgggttggttcattaaaagaggtgccgcagaaataaggccggttgtattgacgccggcctttcgcttatcaaaactgaggctgttcatcaattgaaagaatgctcgaatgtaatgcttgggcgattaagtctccaattcaaagtacttcgcttcttccacgttcaactgcatgaaggaaaaacctgataagctgagatggctgatataagttgatatgacatcgtggactaatgtcttcttatacgtatacttctcagtaatatagatctaaagttcatgtcacttcgttaaaagaaaaagtatcccgcctaacatacaaatgatgataaagaaagcagttgagttcataaaagactgttcttttctcatttcaagtaacctctattcatgatgactaatattaaaactactatatttatagtaccaaattaaagaagatgagaaaatgaattctattataaggggttatgactacaaagagggcgcctccgtgccgaggtgcgctgcttgagggatgcttccattgccaaaatcgaatgagccgtggttgcgggaatacagaaaaacgctatgctgaaaacttcagcatagcgttttttatagattaattccgaatcaggtagtcaaacgcgcctaaagcagcgtttgctccggatcccatggaaatgatgatttggttgtacgggctgtctgtgcagtcgccggcagcgaacaatccagggatggttgtttcgccgcgtttgtcgactgcgatttcgccgatgcggttgcgttcgacggtttcaggcagccattccgtgttcggcacaagaccgatttggacgaagacgccttggagctcgacgtgtttttcttctcctgtttcacggtctacgtaagtaatgccgtttacgttttcatcgcccgtgatttcttttgtttgggcgtttttcacgacagtcacgttggggaggctgtagagccgtttttgcagaactttgtctgctttcagctccggcgcaaactcaagaacagtcacatggttgacgatgcctgcaaggtcaatcgccgcttcgatgccggagttgccgccgccgatgacggcgacgtctttgccttcaaacaatggtccgtcacagtgagggcagtatgcgacacctttgtttttgaactcttgttcgccgggtacgccgatattgcgccagcgtgcgccagttgaaagaatgacggttttgctcttcagaacagcgccgttttcgagttctagatggaaaaggtcttttttctcgaggccttttgctcgttgcaggttcatgacgtcgatatcataatccttcacgtgttcttcaaggcttgccgcaagcttaggcccttcggtgcgcttcacgctgatgaagttctcgatgctcatcgtgtcaaggacttggccgccgaagcgttcggcaacgattcccgtacggatgcctttgcgcgccgcatagattgctgcgctggcgccggcaggcccgcctccgacaacgagtacatcgaacggttctttatcagaaagctcagacgcatctgtgccgctgcccatcttcgcaagaatttcttcaagcgtcattcggccgcttccaaaggattcgccgttcaagtatacggtcggcacagccataatgtttttgctttcgacttctgacttgtatgccgcaccgtcgatcattgtgtgagagatgttcgggttgagcacgctcatcatgttcaatgcctgcacaacatccgggcagttgtggcatgtgaggctgatataagattcgaagcggtactcgccgctgatgttcttgatttgatcgatgattttttgatcgactttcggcggtctgccgcttacttgcaagagtgccagcaccaaagatgtgaattcgtgaccgagcggaaccccggcgaatgtcacgcctgtatcttcttcggcacgattgacgctgaagcttggcgttctgtcgagctgcgccttttcaacagtgatttttgatgacatggaagccagctcttctacaagagccagcatatccttagagacactgtcatcgcctgcactgactttaaggacgatgtcattttcaatcatctgcatgtattggtttaattgtgctttgatatttgcttcaagtaccaattgaatgcactccttagattttgcctactaggtcaaggcttggtgtcagtgtttcagaaccttcttcccatttagccgggcaaacttcgcctgggttttggcgtacgtattgagccgcttttactttgttgatcaggatgctcgcatcacggccgataccgcctgcgttgatttcaacagcttggatgacgccgtccggatcgatgatgaatgttccgcggtcagcaagaccttcttcttcgttcagcacttcaaaattgcgggagatcgtttgagatgggtcgccgatcatcgcgtaagtgattttgccgattttctcagagctgtcatgccatcctttatgtacgaagtgagtatctgtagaaacagagtatacttcgacacctagttcttttagagcttcgtagtggttttgaaggtcttcaagctcagtcgggcaaacaaatgagaaatccgctggatagaagcagaaaatgctccattggcctttcagatcttcgtgtgtaacatcgataaactcaccgtttttgtaagcttttgctgcgaatggttgtacttcttttccgattagagacataatatcgtcctcctgaatgtagtttaagagaaataaaattgtaaactttatttctctataattattataattatatacaaattatcaaataataaatattttttgtcaaggggaaagacctttatttttttgttaagtatttcagctaaagaaaagagttggagtttcattttcatatagtatgattggcacaaatgatagagaagtgagaataaagaggcctaattgaaaataaagaaaagccgtcggaatgacggcttcagcgtgtcgacaaatcctcgcattcgttgtcaggcctgcgcgtcggtgctcacgaattccaacattcgctgcgctccgatgctcggccttcctagactgcaagggttttcaatcacgctgaaaggatgacaaaatcccaaaactaaaagtcgttttgggattttgtcaacaaactaaagccgtcggaatgacggcttttttggctaaactcctttatacgcggaacggtaaatctcagccagctctgaaacgagcggcagcttaggattggctgtcgtgcactgatcttcaaaggcgcgctcggccatgagatctactttgctttcgaatgcggcggcatccacgccgttttgtttaatgctcatcggaattttaagctctttggcaagcgagatgatctcctggatgaggctttcaacaccttctgcagttgtttttgcaggcaggccgagcgttctggcaatctccgcgtagcgctggtcggctatgaaatggctgtatttaggaaatgccgtgaactttttcggcttcgctgcattatagcggatcacgtgcggcagaaggatggcgtttgcccgtccatgagcgatctgaaactcggcgccaagcttatgggctaagctgtggttgatgccgaggaaggcattggaaaatgccattccggcaatcgttgatgcattatgcactttttcgcgggccagctcgtcgctgccgtttttgtatgctcttggcagatattcgaagatcagctggatggccttcatggccaagccgtcagtatagtcgttggccatgcacgatacgtatgattcaattgcgtgtgtcaatacgtccattcctgtgtcggccgtgatatgtttcggcacggtcatgacaaattgcgggtcaatgatcgcgacatccggtgttaattcataatcggccagcgggtactttgtattcgtttctttgtctgtaatgacagagaatgaagtgacttcagaacctgtgcctgatgtcgtcgggattgcgacgaattttgcttttcctcccagtttcgggtatttgacgatgcgcttgcggatgtccagaaatttttgctttaagccaaagaattcagcatcagggtgctcgtagaacatccacattccttttgcggcatccattgccgaacctccgccgagggcgatgatgacatccggctggaatttggccatcatgtcgacgccgttcatcaccgtttcgattgaaggatcaggctcgacatcagaaaaaatttcgcaatgaacgtaatccgggcgccttcttaagtagtgaagggcgcggtctacatatccgagtttcaccattcccggatcggtcacaataaacgcttttgagatgtcaggcattttcgctaaatattgggttgcgtgtttttcaaaatagatttttggaggcactttaaaccactgcatattgacattccttttcgccacttttttcgtgttgattaaatgaacggcccctacgtttgacgagacggagttcccgccatatgtgccgcagccgagcgttaaagaaggcatataggcgttgtaaatgtcgccgatcgctccttgtgacgacggtgcattgacaatgatccggccggccttcatccttaagccgaattctttaacggcttcttgatcgttcgtatgaatcaccgccgagtggccggttcccccgaacgccagcatctcttcggcgcgttttaatccttcttcaagcccgctgactttgtagcacgctaaaacagggctcagtttttctctggacagcgggtcatccggacctacaccttctaattcggcgatgaggatttttgtatcttgcggcactttgataccggccatttcagcaattttgaatgccggcatgccgacgatatcagcgtttaccgcgcaagtattttcattgatgaccaatttttcgacctttgatttttcggttttatttaagaaatagcagttgtttcttgtcatttcggctttgacgtctgagtagatgcctttgtctatgatgacggcctgctctgatgcgcaaatcatgccgttgtcaaatgttttggataagatcagatcattgacggcttgcttcaggttggcagacttctcgatgtagcacggaacgtttccaggtccgacgccaagggccggttttccggagctgtaagcggatttcaccatgcctgcgcctcctgttgcgaggatcagggaaacgttcgggtgggtcattagggcttgcgttgcatccagagaaggcgtctcgatccattggatgcagttgtcgggtgctcctgctttgacggctgcgtcccgaaggattctcgccgcttcgcggctgcatttttgggcggatggatggaaagcaaacacgattggatttcttgttttaattgatatcagggacttgaacatggtggtggaagtagggttggtcaccggcgtcacgccggcgatgacaccgacaggctccgcgatttcaatgactccgtcgtgttcgttttcattgatgatgcccactgttttatcgtatttgatatgatggtagacatactctgtggcaaacatgtttttaatgattttatcttcataaacgccgcgcttcgtttcttcgacggcaagtttggcgagaggcatgtgctgatcaaggccggcaagcgccatctgtttgacgatctcatcaatctgctcctgatcaaagctgcggaattcttccaatgcctttaggcctttttcgactagctgatcaatcatgtttgaggcattttgcttttgtttcatgttcttttcttcgattgccattgtaaaccctccagtgaatgaataggaatttgattacaacaggatgtccagggatgaatgaagtcggcaaagtttgtgaaacatttcacaagttaggttaaaaatttttatccctgaagcggatatctggtttattttggcatcaatcctccttttctgttgttgaatttatcatagcacgaatttgaaatataagtttgtgaaatgttgaacaaagtatgaaaatccatttgagtgaaataagaatgcaccccgagatccggggtgcagtttttaataccagtccgtatgaaacacgccttccatatccgtccgctcatacgtgtgagcgccgaaataatcgcgctgggcctgcaggaggtttgcgtttgagcggcctgtgcggtagccgtcgtaataggaaagggcagtgcttaggcacgggaatgagatgcctgagctgatgccttcgcagacgaccttccgcaagccggactggtattcttttagtttttcagcgaagtcaggtgcgaccagcaggttggacaggtccggctgtttgtcgaacgcctcgctgatgagatttaaaaattgtgcgcggatgatgcagccgccgcggaagatgagggcgatgtcctttaacggcaggttccatccgttcaggtcagatgtcattttgtattgagcgaagccttgtgcataggcgcagattttgcccatatataatgcctgtctgacgcggtcgatccacacgttttgatccaggcgccgttcttctgttgcaggtccggccaatactttttccgcagctgtccgttcgtcttttaatgatgacaggtaacgggcaaacagggattccgtgataatcgatgatggaatgccgttgtcgacggcctgcaggctcgtccatttgcccgtgcctttttggccggttttgtcgaggatgacgtcgatgagtggagcgcccgtcttctcatcctttttccgcaggatctccgccgtgatttcgattaaatagctgttcagctctccttgattccacgtgtcgaaaatgtcagcgatttcatctatcggcaaaagaagcttttctcttaaaaacgtatatgcttcggcgatgagctgcatgtctgcgtattcgatgccgttgtgcaccattttgacaaaatgacccgcgcctttcggaccgatgtagacacagcatggatctccatccacttgggcggcgatttttgtgagaatcggagcggctttttcgtagacgtcccggtctccgcctggcataatggatgggccttttaaagcgccgatttcgccgccggaaatgccgattcccaagtagccgattcctttcgctttcaaactgtcatatcgtcgttctgtatcttcatagtgggagttgccgccgtccatgatgacgtccccttcttcaagcagagggacgagcgagtcgatgacagaatcgaccggtttgcctgctgtgaccataagaaagatttttcgcggcttttctaaagactgtacgaaatcttcaagctcatagtatggcttgactgtttggcctcccgttttttggacgagttgatcggttaaatcccttgtgtagttatagacggcgacttgttcgcctttgcttgccatgttcagggcgatattgctccccatgacccccaaacctatgacaccgattgtattgcacatgtagtacctgctccttcactaaaacttttttatacaaatagacttaacaataaagtaaatcctaatccggccaccgcgataattgtttcaagcagtgtccaggtggcgaatgtttctttcatgctcaggccgaaatactctttgaacatccagaagcccgcgtcgttgacatgggaagcgattacacttcctgcccctgttgcaagcacaaccagtgcaagattgacatcgctttgtccgagcatcggaagaacgagtccggtcgtgcttaatgcagcaactgtcgcggaacctaaagagattcgcagaatcgcggcgatgacccaggcgagcaagatcggcgacatggccgttcctttgaataattcagctacatagtcgcctactccgccgttgatcaagacttgtttgaatgcgccgccgcccccgatgatcaagagcatcattccgatttgagtaatggcggttgaacaggaatccatcacttgtttgatcgggatctttctggcgatacccatcgtataaatcgcgaacaacagggagatgaccatcgaagtcgaggcattcccgattaaacgaatcgctgccaggaagctgttgtctgcaagtcccattgtttcttgaatgagagtaataatagtcgaaatcgacatgataatgactggaagcatagctgtgaagacgctgatgccaaaggctggcgtctcttcaagcttgaacgttttctgttcaccgagtgaagcgatgctgcccattttctcaaatgattgcggtacgatttttttcgccagtttcgtaaataaaggtccggccaaaagaacggttggaattgcaacaatgataccgtagagcagcacttccccgatattggcgccgagttctcccgcgatagccgtcggtcccggatgcggaggcaggaagccgtgtgtgacggataaggccgccgtcatcggaattccgaggtataaaatagaaatcttcaattctcttgaaattgcgaatacaattggaatcaataaaaccaatccgacttcgaagaataaagcaaccccgatgataaaggaggcgatgacgaccgcccattggatgtttttctccccgaatttgttgacgagggtcatcgcaatgcgctgagcgccccctgaatccgcgatcagcttgcccagcatggcgccgagcccgaagatcaatgcgatatggccgagcgttccgccaaggccttgttcaatcgttttgacgatgtcgtcaaacggcattccaagtgccaatgcaacaccgaacgatacgataatcaaggaaacaaacgtattcagttttaaccccataatcaaaagcaataatgcgacaatcccgattgctacgattaataatggcatgataacgcctccaattcttcccctattttttgctggttaagcttctttgataatttgcaatttgtgtatactcgttttccagtgctcgagataagttgataaagatcggcattaattttctgtattctttggccgattcttctttcggcgcgtgtctgtgcgtgcttccgaccatgtcggagacgacatcgaacgaatcgatttttcccgtcgcgtacagtcccaaaatgcaggctccgagacaagagctttcatagctttccggcacgacgacttccgattcgaaaatatcggccatcatttgcctccacacatcagaccttgcgaagcctccggtcgcctgaattcgggcaactggaccgtccatgcattctgtcaacgccaggaagacggtgtacagattgtaaataaccccttccaatgccgcgcggatcatgtgttcttttttatgggacatggtgaggccgaagaatgaaccgcgcacatccggattccagagcggcgcccgttcgccagcgaggtatggatggaacagcagtccgtcggcacccggtctgacgcgttcggcaattttggtcaagacatcatatggatcaatgccgaggcgttttgcggtttcgatttctgatgaagcaaattcatctctgatccagcgaaggacgatcccgccgttgttgactggcccgccgatgacccaatggttttcagttaaggcatagcaaaagattctgcctttttcatcggtttgcggctcatcgataatcgtgcgaatcgcgccgcttgtcccgatggtgacggcgatttcgccttttttaatcgcgttgacgccgaggttggacagcacgccgtcgcttgcgccgatgacaaacggcgtttgcggatcgattcccatcatcgccgccagttccggattgcaattatggaaaattgctgttgtcggaacgagctttgataagtggtcgggcgtgatgccggcaatcgcaagtgcttcttcgtcccaggccaaggttttgagattcatcattcccatcgccgaagctaatgagtgatcaacgacatattgatcaaatagttttttgaaaatatattctttgattccgatatattttttcgctttggcagcggtttcaggatgttcgttcacaatccacgtgattttgcttagcggcgtcatcgggtgaatcggcgttcccgtccgtttgtagatattgtgcccgttcatttcttctttgattttatgagcccagccttcgcttctgttatctgcccaagtgatgcaggaggtgagcggcttgtcgttttcgtccatcgcaatcacgctgtgcatcgcactgctgaatgaaatgaatgacggctgtttgtcgggatgctgctgcatgattttcgccgttgactggatgacggcctgaaagatctcatccgggttttgttcagcggtcgagatgtccggcgtgtgaagcgggtagccgatgctttccttttggatcacgtcccctttttcactgaataaaaccgctttcgtgcttgtcgtaccgatatctatgcctaacatataactagtcattttgttgttcggctcctttcgccagcatttgttgcgacagccatagatcttcaactttaccttgtacgtcatcgaaattttgatgtagggatttaagcatcagatccctgtctttcgttttgatcgcttgaatataaagttcatggttatcgagaattcgttcaaagtcttcgtatttttcttttaagcgggcccgcatggataaaagaataaagctttccatcacaggtttgagattgttccatatcatcaaaatgtaagaatgattgatggagcggacaatcgtttcgtgaaataagacgtcttgaaatgagaactcgtcggcatctttgtatttgatggagactttcatcatctccaatattttgctgaggtctgttaccagttcgtcgacattggcctgtccaagccgttcgaatacgaatgtttccatcaccaggcgcacatcataaatttctcctatttctttttcggttaaaccgatgacaacggcccccatccgttccaaacggatgattttttccgatgccagtatttttaaagcctcgcggatgggagaccggctcaccgagaattccgcagccaatttattttcagataaaatggtaccgctttcaatcaaaccggaaataatgcgcattctcagctcgcatgcgacgcgaacaccagttgaagctctagaaagccacttctccggatataaaaggcctttagattcgctcatacactcaccttcctagttatacgagtatacttgtatacaagtatgataacgcgattattttgattatgcaaacactttcattttaaatttttcgaaaaatttttccatttagaaaccatttgttttgcagaagcgctttgaaagcccccctgaagcaaaaaagtaaagggagcaggtgccctttatgttttgaccatttctgtggcaatgttgtacaaagccttcggaaacacctatcttgttttcgtttgttaatttaattaattaaccatggtacaataaaacctacgatatggtgtaaatggaggatttcacatgcagcgtggtacatttcaattaatgaaatcggtgaacaaatcgatcattcttaataaaatcagaacttcagagccgatttcgagagccgagatcgccaaggaaacaaagattacccctcccacggtctcaagcattgtcaaagagctgatcgaacaagggctcgtgaaagaaagcacgctcggccattcgagcggcggaaggaagccgacaatgctgcacatcaacacaggtgcctattatgtcattggcattgatgccgggcctgagacggtggagtgcatcttaaccgatttagccggagggatactgcagcggacatccagcctgctgaaaaaaccgctgacaaacgagacgttcattgatgttttaaaagaaaatgtttatgcgattttgggacgggccgatgtcaatcaggaaaagatcatcgggatcggcatcgcaatgcacggggtcgtcgatgctgaaacgggaatgtcacgcatcgccccgattttaaacctaaccaatattcccattaaagatgtgctggaacaagaattcaacttaacggtcagagttgaaaacgatgccagggcgatggcgcttggcgaatcgtggttcggcggccgcgatgacgcagggagcatggctgccgtgaatatcggccgcggcgtcggtgcggggatcgtcatcaacggaaaactgtaccatggagctgaagggatcgcgggtgaactgggccatatgatcattgatatcaatggagaaaagtgcgagtgcggcaaccgcggctgcctgcagacgattgtgagcggaaaagcaattgccgaacgggggaaaaagcggttgaaagaaagcactgacagcctgacagccaaagatttgtttgaaatggccgagaacggctgccaaacatgtatcgaactttttcaggaaaccggtgtgatcatcggaatcgggctgaccaatttcattcatcttgtcaatccgggcaaaatcgtgctgggaggaggagtgatgaagggcgggaggttcatattgccggcgatacgagaaacgatacagcagaaagctttaacagccgaagcgaggcagacagaagtgacgataacgaagctcggcgatgaagcgacgctttacggagccgtttcattgctgctggcggagctgtttaatccggtgctaaaataagcttattttttcgcctattttaacaccggtgaagccttacccctgatgattgactgtgcggataaagcgcatgaaagcttcgcggtctttgaatactccggcgtcctcaagggctttgacaaatttcttgccaagttcttttcgtacaattgattcagcctgctccggttcggacatctctccgtattcggttttgagctgttcggcccattcccggtgatgcgcttcaacggcatctgactgaccgagcaggaattctttcactgccgccaattcggtctttaagcggggaggaaggacggccaggcccatcacttcgattaagccgatattctctttcttaatatggtgaacgtcagcatgcggatggaatatgccgtatgggtgctcggcagatgtccggttgtttctgagcacaaggtcgatttcataaacgccgctcacgtttcttgcgataggcgtaatcgtgttatgtggcgtgccatctgtaaaagccgagatatccgcttgttgatccgagtagtttttccaagtctgaaaaatatggtccgccgcttcaacaaggctgttgatcgcagttcctttcaagcggatgacggacatcggccattttaaaacggaagcttcgatggccggatgctgtttgatttgaaaggagaacgcgccttccgcgcgcgtcatcgcaaactcatatcgtccggcctgataatggtcatggcttaaaatagacccgccgacgatcggcaaatcggcattcgatccgataaaataatgcggaaacagctcagtaaaagcaagcagcctgtgaaaggcaagcttatcaattttcatcggccgatgctgctcagaaaataaaatgctgtgttcgttatagtaagcatatggagaatattgaaaataccagttttctccggcgagcgggactttaataatcctgtggtttgcccgggcaggatacccgattcgtcccgcatacccctcgttttctttgcacagcaggcacatcggatagctgcgcgattgttttgcagcggcgcgttcccgtttgatttgttcagggtctttttccggctttgacaaattgatcgtaatatccattgtgccgtaaggcgtatccatctgatacgaaatatttttttcaattcgcttcgtctggatatagttgctgtttttgctgagctgataaaaatattcggtggctgccagcggcgattgttcgtatttctgctggaacactgcattgatgacagaaggtcttgcaacaaagcagttcatcacatttgccgccagcatgtctttcgcgtctagatcgtcggttatcacgccgtgttcgactgcataggctgcgagtttttccaaaaggtctgggatggagtcgccggaagcagcagtggcttcctcaggaaacgattccaagcccagcagattcatcacttggttgcgcgcgtagttcacgtcagccggttcgattaaccctgcttcaagcgctttttgaatgagtccggctatgtcttgttcaatcatgttgacacttccttcctgtaaccgtttggatgcgaggaatgccacttccatgcatcttcaataatctttgctacagatgtgcgcgaaggcctccagcccagaacttgctttgccttgtgagagccggcaatcaggatgctcgggtcgccggctctgcgcttgccgatctcggcggtaatgtctttcccggttgcctttctggccgcatcaatcatttctttcaccgaaaatccttcgctgctgccgagattgaatatatcgcttttgccgccttttcttaaatagtctaatgccgacagatgagcgtcaatgaggtcttcaacatgaacatagtcgcggatgcatgtgccgtcgggcgtatcatagtcatcgccgaaaatcgttatatgcggtctttggccgagagcggtctgcaggatgagggggactaggtgtgtttccggacggtggtcttctccgatttctcccgtctcccttgcccctgcaacattgaagtacctgagagacacaaagctgatcccatgggcttcttcagtccgcttcatgagcttttccatgatcagtttcgtttccccgtaggtgcttgtcggcattgtcggcatgtcttctgtaatcggcaccgattcaggctctccgtagacggccgccgtcgaggagaatacgattttttttacatcgtgctcgagcatcgcctgaagcaaaacctgtgttccggatacattgttgtcgtaatatttgagcggatctttcatcgattcgccgacaagtgaactggcggcaaaatggatcacttcttcaatacgttccttttcgaaaaccgtgcggaggaaatcgcgatcgcgcacatccccttcataaaagatcgcatcaggatgtactgcctgtctttggccggtctcgaggttgtcaacgacaacgacgttttcgcctctgtctattaattggtacacggcgtgtgaaccgatatagccggcaccgcccaaaaccaacacgctcatatccattcccctttctatatttctttggcgccgtcgcctattgccgcagtataaaaagcggcatcatagccaaccgtttcgcggtagacggcattcacgcgttctttaaagctgtctgtccggtctttttctacaatcgcaatcgcacagccgccgaacccggcgccggtcatgcgggcgccaaggacaccgtcttgttcccaggccgcctggacaatggcatcaagctccagccccgtcacttcataatcatcccttaatgacaaatgggattcattcatcagcttgccaaatccggcgaggtcgccttcgcgaagtttttcaagcgccttcagcgtccgggcattttcgtagacagcatgtttggcgcgtttttgattgatttcatttctgatgaggtgctgatgggcttcaaatccttccatcgtcaattcgcccaggcttgcgatcgacaactcctgttgcagatcgccgagcgcctcttcacattgggcgcgcctttcattatatttagacccggccagcgtccgctgtttgtttgtattgatgatgatcacatcgtgttctttcaacacgaagggagcgtatgtgtaatcaagtgtacggcagtctagcaaaatcgcgtgatcctttttccccatgccgatcgcgaattgatccataatgccgctccccacgccaatgtattcgttttcgactttttgtccgagcttcaccatggagatcgtgtctgtctgcaaatcataaagcccttttaacaaaacgcctgtcgcaagctcaatcgatgcggaagaagagaggcccgctccgtgcggaatatttccgtaatacaaaatatcggcgccgtgaacgatttgatggcctgccgctttcgtcaaaaggaacattcccttcggataattggcccagccgtcggactggtcaaaggctaaatcgctcaagctgcattcaattattccttcgtcagggaagttctttgaatagaagcggatcatttgatcatcgcgcttcacgccaagggcataggtgccaaatgaaatcgaggcggggaaaacatgccctccattataatccgtgtgttcgccgattaagttgatccttcccggagcaaaaaaggttcgcggtgtcttttctgtcttaaaaatagaacgaaagtcgtttgataaagcggctgcagtattcatatatcctcctattcgtttgacgtaccagacttaataaattaatttaattaagttcaaccccagtttactacgggttttcgattggtgcaataaaaagtgttttttcaaatgaagcgttttcatgtaaaatccttattggcggggatagggcaatcagcacttgacttttacgcaaatcaacgttaaattagtaaaatattttactaaaaaatttgatatttaaaataaaggtgttcatatggaggttttacaatcgtggcgacgataaaagatgttgcagaaaaggcggggtattccatctcaacggtttcccgcgtattgaataacgacgaaagcctttccgtacccgatgagacgcgggagaaaatatttgaagtggcggaaagcctgaactaccgcaagaaaacgatcaggacactggtaaaaaacatcgcgtttctgtactggctgacggataaggaagagctcgaagacgtgtattttaaaacgatgaggctggaaatcgagaagctcgcaaagcaattcaacgtcgaactggcaacgtataaaatttcgggaggcattgacgccattcccgaaaacatagaaggattcattgccgtcggctcgttttcagatgatgaattaatccgattaagacagatgacgcctcacggtgtatttatcgattcgacgcctgatccgaatcactttgattcagtgaggccggacttaaagcagatgacgaggaaaacggtagattttctcattgagaaagggcatgaaaagatcggctttatcggaggtacgtaccacaaccccaatacagatgaagacgaaatggacgtaagggaacgaacgtttcgcgaatatatgaaggaaaaagggctcttggaggaaagctttattttttgccggaggggtttttcggtggaaaacggctaccatctgatggacaaagcagttgaaacattgggagaaaagctgccgacggccttttttacagcggcggatccgattgccgtaggctgccttcaggccttaaatgaaaaagggatcgccatcccgggcagagtcagcatcatcagcatcaacaacatcagtgtagcgaaatacgtatctcccccgctgacgacattccatatcgatattaaagagctttgcaaaaacgctattgaattgcttttggaacaaatacttcaaaaaagaaaagctgtaaaaacgctatatatcggtgccgaactggtggtcaggaaaagcaccaaataaaaaagcgcgggctgctgttcacaagccgcgcttttttcgtaaaacattttactgggataagtaaaataattgtttacacttttcctaagacatgctatattgtttttgtaaagcgctttcactccaataaaaggaatgagacaaatgatgaatatgaaaaaatatgttggaatcagcagtgtcattgctctcagtttgtctttaactgcctgcgggcctaaagagagcagcaatggagcatcagactcgaagcaaaaggaactcgtggtctgggaagataaagagaaaagcgaaggcattaaagatgccgtcgcccaatttgaaaaagagcacggcgtatctgtcaaagtcgttgaaaagccttacgcaaagcagatcgaagacttgcggatggatggaccggcgggaacgggtccggatgtgttaacgatgcccggagaccaaatcgggacagcggtaacggaaggtttgatcaaggaattaaaggtggacaaagagatccaatcgatctatacggaacctgccatgagatcgcaggtgacaaacggcaaggtctacggcctgccgaaagcggtcgaaacaacgatgctctactataataaagatttaatttctgaaaaagaactgccgaaaacgctggatgaatggtatgagtattccaaaaaaacggctgacggcaaaaaattcggcttcctggcgctgtttgaccagatttattatgcacagagcgtcatgggagggtacggcggctacatttttaaaagcgatgccgacggcacttatgatccggccgacctaggcttgaacaacaaaggtgcagtcgaaggcgccgagtacattcagaagttttaccaagaggggctgttccctgccggaattattggggagcagggcatcaatgtgctggaatcgctgtttacggaaggaaaagcagcagcgatcatttcaggcccgtggaacctggaaccgttcaaaaaagcgggtatcaattacggggttgccaagctgcctaaactgtccaacggcaagcatatgagttcttttgtcggcgtgaagagctacaatgtaagcgcttattcgaagaatgccgatctagccgaacaattagtcgtcttcctcgccaataaagaaaactcaaagaagagatatgagatcacaaaagaagttcccgcagtcaaagaactggcggatgatcctgccgtcacaaaaagcgaagcggctcaagccgttgccgagcaatctcagtactcagagttgacaccgaatattcctgagatgaatgaagtatggacgcctgcggatgcggctctgcaaacaattgcaaccggaaaagccgaaccgaaaaaagcgcttgatcaagccgcggaaacgatacaaggacagatcaaagcgaagcacagcggcagcaaataagccgcgggcggtggtgtcaaacttgtcttaagtttggcgccatttattataagcacgtccatataaagaggtgaaggagaaggtgcagcatcgcaaaaaagctttactattatcaattattcccggtctgggccaattctacaataaacaatggataaagggtctgttattccttcttttaggcgtctcgttctttgcggtttttggcgatttgctgaatatggggctgtggggcctgtttacgcttggaaccgaagtgccgcgcgacaactcgatttttctattggcagaaggcattattgctgtgattgtcacctgttttgggctggctgtctattacgccaatttgcgggacgcctaccaaaacggaaagaggcgcgatgaacaaaaggagctcagttcactcaaggaacaatatcataatttaatagctcagggatatccgtatctcatcagcgggccatcgctgttcatcctggtttttgccgttgtttttccgattttgttcagctttgcattagcttttacaaactataacctctaccattctccgcctgcccgccttgtcgattgggtaggaattaaaacgttttccgaaattttcaccgttgatatttggcggtcgacctttttggatgttttagcttggaccattgtttggacgcttgtcgcttccacgctccaagtcgggttgggaattttgttggcggttgtcgtcaatcagaaggaagtccgctttaaaaaaattttccggacgattcttgtcttgccttgggccgtgcccggttttgttaccattctcgtgtttgccggcctttttaatgacagcttcggtgctttcaatcatcaaatcctcgccgcattcggcatcgatccgattccttggatgacgaatgccaattggacgaagctggcgcttattcttatgcagggctggctcggatttccgtatgtgttcattgtaacaaccggtgttctgcagtcgattccggatgacctttatgaagcggcgacgattgacggagcgtctgcgttttcgaaattcaggcatattacactgccgctgattttaatcgcgatggcgccgattatcattacgcaattcacttttaattttaataacttcaatattatttatctattcaatggaggcggtccggctgttcccgggtcaacagcgggaggaaccgacatcctggtgtcctggatttacaaattgacgatgcagtcgagccagtactctttagccgccgcattgacgatcctgctgtcggtctttgtcatctcaattgcactgtggcagttcagacggacaaattctttcaaagagggggcttaacgtatgaagaaaagaagattctttcggctccttctgacctattctctgttggcttttatgacagccgttatcatataccctctgctttggacggtgggggccagctttaatcccggcaacagtttggtcagcacttctatcattccggcaaatccgacattggatcactataaagaattattcgccggcaaagagagcctccaatacgggcaatggtatataaactcgctgaaaatcagcatctttacgatgatcggatcggtcatcagcgtttcttttacagcttatgctttttcacggtttcgttttaaaggaaggaaaaacgctttagttttattcttgctgctgcaaatgattcctcaattttcggctttggttgcgctcttcgttttagcgcagatgcttggaatgatgaacagccattggctgctgattttgctgtacatcggcgggctcataccgatgaacacgtatttgatgaaagggtatatggactccattcccatcgatttggatgagagcgctaagattgacggcgcaagcaatacaaggattttcctgcagattattatgccgctatccaaaccgatgatcgcggtcgttgccatgaacggattcaccgggccgctcggggatttcgttttgtcttcgacgatattgcggacaccggagtcgtatacattgccgatcggtttatacaatttagtcaatgaggtgatgggagccagctatacgacgtttgccgccggcgctattttgatcagcataccggtagccgtcatctttatcatgctgcaaaagaactttgtgtcaggattgacggcaggcggaacgaaaggatagtccgaaggagaaaatggtctaaaaaaggagagtattatgccaaaaatttatacgacccaagcaagatacatgcttcacgggggagactacaatccggatcagtggcttgaccgtccggatattcttgcagatgacatcaagctgatgaagcttgcccatacgaatacattttcagtggggattttttcatggagcgcccttgagccggaggaaggcgtctatacgtttgaatggctggatgatatttttgagagcattcaccggaacggcggccggattatattggcgacaccgagcggcgcccgtcctgcttggctgtcgcaaaagtatccggaagtgctgcgcgtgaatgctgaacgcgtcaaacagctgcacggcggaaggcacaatcattgcttcacttcatacgtataccgtgaaaaaacgaaagagatcaaccgcatgctggctgaaaggtacggcagccagcatgcccttttgatgtggcatgtttccaacgaatacggaggagaatgccattgtgatcaatgtcagcacgccttcagagactggctgaaaaagaagtacaaccatgatattaaatctttgaatgacgcatggtggacgcctttttggagccacaccttcaacgattggtcacagattgaatcgccgtctccgatcggggaaaatgcggtgcacggcttgaatttagactggcgacgcttcgtcactgaccagacgatttctttttttcaaaatgaaatcgttccgttaaaggaaatcacgccgaatattccgattacgaccaattttatggcggacacgcatgatttaattccgtttcaagggctggactacagcaagtttgccaagcacctggacgtgatcagctgggacgcgtatcccgcctggcacaacgattgggaaagcacagcagatttggccatgaaagttggctttatcaatgatttgtaccgcagcctgaaacagcagccgtttctcttaatggaatcgacgccaagcgctgtcaattggcacgattttaataaagcgaaacggccgggcatgcacctcctgtcttctgtgcagatgatcgcacacggatctgacagcatcctctattttcaatggcggaaatcccgcggctcatcggaaaaatttcatggtgcggttgtcggccatgacaattgttccgagaaccgcgtgtttaaagaagtggcaaaagtcgggcaaacccttgaagcgctgtctgaagtcaccggaacgatccggcctgcggatgtcgcgattctctacgattgggaaaaccattgggccctccaagatgcacaaggattcgggatgaaaaccaagcggtatccccaaaccctgcacgagcactaccgcgcgttttgggagcgtgatattccagtcgacgtgattacgaaggaacaggatttttcatcgtaccggctgctgatcgttccgatgctttacttagcaagcgaagaaacaatcgcgcgcttaaaggcatttgctgccaacgggggcacattggtgatgacctatattagcggaatcgtcaacgaatctgatctgacctatttaggcggatggccaaaagatctgcaagagatgtttggcatggagcctgttgaaaccgatacactctatccgggcgataaaaatgcggtccgttatcaaaaccggtcgtatgagctgaaagattacgcgaccgtgctgaagctcagtacggcagatcccgagggattctatgaggacgacttttatgcggacacgacggctgtgacgagccatccatacaaacaggggaaaacgtattatatcggtgcgcgtttaagcagccaatttcatcgggatttttatggaacattgattaaagagcttgcgattcaaccggctcttgacgtgaaacatcagcctggcgtctccgttcaagtcagacaggatgaggaaaatgactatattttcatcatgaatttcacggaaaaacgtcagcccgtcgtgttggcgtcggcagttaaagatatgctgaccggagaaacgctggccggcgaagtcacattggaaaaatatgaggccagaatagcggtaaaagcaaaagaataggcctgggaggacatccgctttaaggtggatgtttctccgggtgaataatgaaagcgttttctttttgcttgtgtgtctattatgaaaggggagaagcgagattgatgaagaacgtgctggctgtttttgtggtgctgatatttgttttgggcgcatttggaacaagcggtccggcggaagccgccagagattcagggacggcaaaaagcgacctttatgttgaaaaggtttcagggcttcgcaaggattttataaaaggggttgatgtttcgagcatcatcgctttggaagagagcggcgtcgccttttacaatgaatccggaaagaaacaggatatattcaaaacgctgaaggaagcaggcgtcaattatgtccgggtgcgcatatggaatgatccctatgatgccaacggcaacggctacggagggggcaataatgatctggaaaaagcgattcagatcggaaaacgggccactgccaacggaatgaagctgctggcggatttccactattccgatttctgggcggacccggcgaaacagaaagcgccgaaagcatgggcgaacctaaactttgaagataaaaagacggcgctttatcaatatacaaaacaaagccttaaagcgatgaaagcagcgggcatcgacatcggcatggtgcaggtcggtaacgaaacaaacgggggccttgccggtgaaacggattgggcgaagatgagccaattattcaacgccgggagtcaagcggtgcgagagacggattcgaatatcctagtcgccttgcattttaccaatccggagacgtcaggaaggtacgcttggattgccgagacgcttcatcggcatcatgtagactacgatgtgtttgcaagctcgtattatccgttttggcatggcacgctgaagaatttaacatctgtcctgacatctgtcgcagatacgtacggcaaaaaagtcatggttgctgagacatcttatacgtatacggctgaagacggagacggacacggaaatacagctccgaaaaacggccaaacgctgaattatccggtcaccgttcaagggcaggcgaacgcggtccgtgatgtgattcaagcggtcagcgacgtaggtgaagccggaatcggcgttttctattgggaaccggcatggattccggtaggaccggctcaccggctcgagaaaaataaagcgctttgggagacatacggatcaggctgggctacaagctatgctgctgaatatgacccggaagacgcaggaaagtggtttggcggcagcgccgtagacaatcaggcattgtttgattttaaaggacgtccattgccgtcgcttcatgtgtttcaatatgttgatacgggaacaccattcaaaaattgacttgtggccggtttcttagatgaaggcgacgccgtttgccggaaagcggccttgaatgtttaaagcagaatggaaaaaaggccggatatcatccagccttttttcgtgaaaggacagtcagaaagagttgttaaaatgttctcaagagataaaatccgcttaaccagcggttaccgtttgaaatgcatcttctacagatacatattcatatccaaggtcgcgcgcgacggccttgtaggtgatgcttccgtttgcaacgttgacgccgagagcgagcgcctgattttcggcgactgcttgttcaacgcctttatttgcgatttgcaaggcgtaaggcatggtgacgtttgttaagccgatcgttgatgtacggggaacggctcccggcatattggcgacggcatagtggacaacgccgtgcttcgtgtaagtcggatcgtcatgcgtagtgattttatcaaccgtttcgataatgccgccctggtcaatcgccacgtctacaacaactgaacctggcgacatcgacttgatcatctcttctgtgacaagcttcggcgcttttgcaccaggaattaagacggcgccgatgacaaggtctgagtcttttacggcttccgcaatgttgagcggattggacataagcgtttgaatgtctttgccgaactggtcatcgagctgacggaggcgctcagcgctcaagtcgatcaaagtgacgtcagcgccaagtccgacagcgattttggcagcgttcgtaccaaccactccgccgccgatgatcgtgactttgccgcgttttacaccgggtacgcccgataacaggatgcctttgccgccttttgatttctcaagaaattgcgcgccgatctgcgaagccatgcgtccggcgacttcactcattggagtcaagagcggaagcgtccggttcacttcgaccgtttcgtaagcgatggctgtgacgccgctgtccacaagcgctttcgcaagcttaggttcagccgctaagtgcagataagtaaataaaacaagtccttttcggaaatagccgtattcagagctgatcggctctttcactttcatgaccatatccgcttttccccacacatctttcgcttcagccaaaatgtccgccccggctgctttgtagtcggcgtcctcgaatccgcttccaagcccggctccctgttcaattaaaacttgatgaccgcttttttttagcgcgactactccggccggagtaatggctacacggttctcgttgtttttaatttctttaggaattccaatgatcatgatgtcgtccccctcaaatgaaatatgattctaccgctagtataaatctctgaatcgggaagagcatcgtgtgtaaaattaaaaatgtaagcgcttttttgtgaaatttaacaaattggtgaacgttgaataaggtgaaaggcttgaggagataagttatctatttaaatttttttctttaaaaaatagctttgttaaaaaaacaaatgtaagcgattacattttgtgtcgtttcacaaacataaccattttccattgtgatagaatatctcatgcagctatgaaagcgttatctttgtcaggagtgagtcatatggatatcttagaaatactaggcgagattaataaggtactatgggggccgcccagtttaattttattatttgggacaggcttatttttaacgattgttttaaaaggactgcaatttcgccgcctgatctatgcgtttaagatcgggtttggcaaagaagacagcaaagacgcggctgccgaaggggatgtgagccattttaaggctttgatgacagcgctcgccgctacgatcggaaacggaaatatcgcaggtgtcgcgacggcattgacactcggcggaccgggttcgatcttttggatgtgggttgtcgggctgttggggatggcaacgaaatacgcggaagccttgctggctgttaaattccgcgtaaaaaatgaaaaaggggaatattcaagcgggccgatgtattatatcgaacacggactcggccgcaaatttaaaggactcgccatcgcctttgcgctgtttggagcttttgccgctttggggataggcaacagtgtccaatccaatacgatcgctgatattacgaagaacagcttcggcatcgaaaactgggtgacagggctgattctcgtcattctcgtcagcgtcattatcttcggcggcatccagcggatcagcaccgttgccagcttctttgtgccgatcatggcttttctttacatgggcggggcgatcttgattctgattttgaattatgacaagattattccggcttttgcgctgattttttattatgctttccaccctgtagcggcagccggcggcttccttggaattgccgtatctgaagcggttcggaacggggtatcccgcggtattttctcaaacgaagcaggccttgggacggcggcgctaatcgccggaaatgcgcgcgcagaccatccggtaaaacaggcgctcgtcgcaatgaccgggacatttatcgtgacgatcgtggtgtgtacaatgaccggtttaacccttatcattaccggtttctgggacccgtccggcggcttgatatcaggcgtggcccataatgccagcctggaaggcggggcattgacaagcgcagcttttgcttcagtactcggcgcggcaggcgaatacattgtgtctctgtcggtcattttctttggcttctctacaattgtcggctggtatgtttacggagaaaagtgcttcgaatatttggcaggcgccaaaggaattgcgggctacaggctggtctacatcctcgcctgcggcatcgggacggttgccaacctcgtcaccgtctgggcgtttgccgatatggcgaatgcgctgatgatgattccaaacctgatcgccatcctgctgctttggaaagtcatcaaagcagagacaaatgattattttcaccacttctatgaacataccaaatcggcgggcccgccaagtaaaccaattcattaaaagctctgccttcccggcagagctttttcttcggcttatattctgcaccttctcaaattttgacgaaatatgtcgatactatggagggaagaagatgtttgatttgaaaactgtttttcatcattgatgacataaaggagaaagggtcaccataatgaaagtgaaaacaaaactgctgggaatcatatcaattctagtcgtttcaatcctcggaatcggaatctcctctgtttttatgatttcttctacggtgaaaaagaatgaagaacttaaggacaagatggaatttcaaaaagagattaagcatattcaataccgtctgaccggcttgtcgaatgacgagagagcccttattatgaccggagacgatgaatacagtgaaggaatgaaggacaaggccgacgatgttttaaagagtcttgaccgggccggaaaactgatccgggaaaaatcatacaaagcgaacgtcgaagaaattaaagaaaacttcaaggcttattgggatttaaatcaacaagtcatgcagacttacgcttcaagccttaaaaaagcggaatcgatccatttcggagaggaaagaacattaagaaaagatgtcctcgatccgtctgtcaatcagctggtcgaaagcctggaacaagaggtggatgatctgaaagcagagatcagagccaatgggacgatgagcgaatgggtcatcatcgctgtcacaggagtatcagcgatattgggaattgttttgagtctgctgctcttgaagtctattctggtaccgttgagaagcctgaatcagcagcttgaggacatcgcccacggcgaggcggatttaacgaaaaaagtgatcgtcaaaaataaagacgagttcggccagcttgccaattctttcaatgcttttgtccagtcgctgacgcaaattgtgaagcagatcagcagctcgtctgagcaagtcgccgcatcctctgaacagttgtccgcaagcgcggaggaatcgaaatcgacttccgaactgatttccgaagagatgcaggcgattgccgacagcaacatgacgcaaagcgaaatgacagaaaagagttcagaagcaattcatgaattgctggaccgtttatcatccgttgcctccaatacaggcagcatagcggatctgtcgtcttcgatgagagacaaagccgaaatcggctccgagtccgttcataaaatgctcgaacaaatgaacttcattgataagtcagtcgactcggccggcagcggcctgcaggcgctcgtgtccagcacggcggaaatcagcaacatttcttcgctcatcaccgatatttcggagcagacgaatttgctggcgctgaacgcggcaattgaagcagcaagagcgggagagcaaggaaaagggtttgccgtcgtggcggaagaggtccggaaattggcggacgaaacgaataagtcagcgaaccacattcaatcattggtcacaacgatccaaaatgaatcggtagaaacggtaaataatattaaagtcgttcaagaaaatgtcagctccggtatagctttgtcgcaggagacgaccggtaatttcaacgaaattttaaacttggtggaacaggttgcttctcaaatccaagaagtcgcggcttctactcagcagctgacatcaggtgtcgaaatggttcaaaacaccattcaaacattggcttccggatcacaggaaacgtcagccagcacaaaagcggttgcttcctcaacccaggagcagctggcttcaatggaagaaatctcatatgcagcggaatcgctgtcccaattggctgaagaacttcaaaccattatcaatcgatttaaatattaagcagaaaaccccatccggcgatggggttttaattggttttcatggcagccaaagcgccctcggggatttcttcttcgtgtacttcagtcaagcttttggctttcgttccgtacgccaatactttgatgaaagcgccgggatgcagtttttcgtctgcctctgcctcaatctgctgtttgtgtccgctcgcgtcatagccggttaatgtgtagttgtactttccgttatccggcttttctgcatgatcctcagctttgagataataagcctcaggctttccctggccttgtatataatcatcggccagcggcacaaggcctcctgtcgctttctgcaggataaaaacgccggcaacggcgatcagaaccgcggcaatcaggccgcccgcccgtgtcttcatataccgtctcctctttcattcagttttgtggatggtattattttataaaaaagcgcagagagaagatattgattcctattacaatacacttacatgattgtaaggtaggatggatcgcggcagtttttgtttatcagaccgcttcgtgtcataatatatccaaaccaaaaggagagaccgagatgcaaaaagtgatgattgtagaagacgacccgaaaattgcagatttgttaaaatcgcatattgtcaaatacggatacaacgttcatgtagtgaaagactttgaccgtgtcatggatgagttcagaagcacggcgcctgatcttgttctgcttgatattaacctgccgagctttgacggctactactggtgccggcaaatccgccaggaatcgatttgccccgtcttgtttatttctgcgcggacaggtgaaatggatcaggtgatggcattggaaaacggcggagatgactttatcaccaagccgtttcacgccgagatcgtcatggcaaaaatacgcagccagcttcgcagggcttacggcgaatacgcggcgaaggcggaggaacggctgctggaaaaagaagggctgcggctgtatccggaaagacttgaactgacatttgccggtcaaacggctgctttgacgaaaaaagaagcggatattattgaaagcttaatggaacgccatccgagaatttcaggccgcgaagatttgctggccaagctgtgggatgatcaggcatatgtggatgaaaacacgcttaatgtcaacattacgcgcgtcagaaaaaagtttcaggagctcggtattgaagatgcagtggaaacagtgcggggcgcgggctatcgcttgaatgtatcctgggtgaaggcgggagaggaatgaagctttttttcaaagagcactatttgttgattgccgtgcaggcgctgcagtttatcacaatgctgtcagtgtactggcttgatgggtatcagcacatcagaccggctttttatgccgtttttctcggctttttctttcttggcttctatcttttctaccattactatacgcgccggaagttctacaaacggatgacgagcgggctggagtcattggatgacaccttcaggcaatcgaatcagccccaatcccctttgtcggaagcgcttgaacagctgctgaaaagccagtacaagcaataccgccaagaattaaagaagctggagcttggccaaaaagagcatttgactttcatggatcaatgggtgcaccaaatgaagacgccgttgtcggtcatcgaactgacggctcaaaatttggatgaaccggaatcatccagcatccgcgaggagaccgagcggatgaaaacgggcctcaatacgattctctatatggccagactgcggacgatcgaacaggatttccgtataaaaccggtcgcattggcggatatcgttcacgaggtcaatcgcgaaaataagcgcttttacattcgcagtcaagtttatcctaagttcaaagaaatcaaaaaaggcatcaccgtcgaaacagatgaaaagtggctgtttttcatcatttcccagtttgtcaacaatgcggtcaaatattcggcggggaaaagcaatacagtcattatttctgtatacgaaaatgattcggaagcggtattggaagtggcagatttcggcgccggcatcccggatacagatcaaaagcgggttttcgacccgtttttcacaggagaaaacggacgccgtttcagagaatcgaccggaatgggtctttacttggcaaaatcggcggctgaccagctcggccaccggatcgaacttgattcacaagaagggaaaggcacgacaattcggctgattttcacggctacgcaaaaccttacatcgatgtaatgaaagtgaaagaagaatcgatagttcatcaacaagagatttaggtaaactggtcacagatcgaaagttaaaggtgaaaggagatcttgtgatgcttcaggtcaaacaagccagtaagatttacgaaggaaaaattgcgtaccgcgcgttaacagatattaacctaacaattgataaaggtgaattcgtcgggatcatggggccgtcgggaagcggaaaaacgaccctattaaatatgattgcaacgatcgatgagccgacgacgggcgaaatattgatcagcggccaaaacccgcatgttctcaaaaaagaaaaattggctaaatttcgccgcagagagctgggatttgtgtttcaggactttaatcttctgccgacattaaccgttgaagaaaatatcgtacttcctttgacgcttgacggcgaaaaggtcaaggaaatgaagcggagggcaaacgaattggccgaaaagctcgggattacccagatcatgaaaaagcgcacatatgagatatcgggcggtcaggcccagcgcgccgctgtagcgagagcgatgattcattcgccgaagcttctgcttgccgatgagccgacaggcaaccttgattcaaagtcatccaaagatgtgatggaaatgcttgagtcgatcaaccgcaatgaaaaagcgaccatgatgcttgtcacgcatgaccctcaggcggcaagctattgcaaccgggtcgtctttattaaggacggaaagctgtattcggagatcaaccgcggcgataaccgccaagcgtttttccaaaagattctcgatacgctgtccttgttgggaggggatgcaaatgacctttcgtcagttcgcgtttaacaatgtcattcgcaacaaaaggctgtatgccgcttattttctcagcagcatgtttacggtgatggtttttttcgcatttgcgatttttgctttccacccggtgatgaccagtgattctttgacttccggcatcgggcagcatgcatcctttggcctgctggtcgccggcggcattatttttgtcttctcttttttctttgtgctgtactcgatgagttcatttcttcaatcgagaaaaaaggaattcggcgttttaatgattcaagggatgtcgatgcgccaaattcgcatgatggtatttcttgaaaatatgctgattggattttttgcgacaatcggcgggattgtgctcgggctcgtcttcgccaaattgatactgctcactgcggaaaatgtcctgattattgataacaagctcgatttttacttcccgttgatggcgatgattgtgacgttaatttcttttaacggtctgttcttatttatctcttttcttgtgtcgtttgtgctcaggagcgagaagctgattgttctgttaaaagggaacaaaatctccaaaggggagccgaaagcatctgccttgcttacgctggttgctgctgtgctgcttgccggaggctattacaccgctttgattgtcaaagaaggaggcgttcttgtggcgatggtgccggtgacgattgttgtcattatcggcacatatctgctgtttacgcagctgagtgtttatgtgatccgcaggctcaaaaaacgggaaaccctgttttggcggaaaacgaatatgattttgttttctgatctgtcttacaggatgaaagacaatgcgcggacgttttttatggtggccattatctctactgtcgcattcagcgccattgggacgctgtacggtttccaaactctggtgacaaacggaattaaagagatgaacccgcatacgttctcatataagccgccggaaacaaacaaacacatcgaaaaagacgtggctttcatcaatgacacactggatgaaagaaatatcaaaacagacaaagcttcagctgtccttcaatatttcgatgtcggcggcaatgacatgctgattgtgaaagaatctgactataacaagtttgccgatctcgtcggagccgaccacgtcaagcttgaagacggaaaagcggcggctgccgagtatgaggtcaagatcggcttagagggagatgatgaccagcagctcccttcgtcaatcccttttgcaaatggaaaacaactgaaggctgatcaaacgatccgttcaaaagcgttatctgaacccagctattatattgtgacagacaaagatttcgcacagctgaaaaaaccgaaaagcgaaaaccggttctatgcatggcaggcaaaagaagctgacggcatggctttagtgaaagccggggaggctttgcaaaagaaactggattacatgtatttcggggctgtagattatgaggtatataatataagcaaagggtatggcccgatattatttgtcggactgtttatcggaatcgtcttcttcgtttcagcaggaagcttcctctatttccggttgtacactgatttggacgatgataagcagaaattcaaatcgattgccaaaatgggcttaacagaccgcgaactgcataaagtgctgaacaggcagatcggcatcttgttcttcgcgcctatcgctgttgcccttgtccatggagctgtggcgctgaccgctttatcgcatgcctttcagtacaacctcttcaaggaatctgcaatggtgctcggcgtgttcttcgccatccaggtcatatattacttcatcgtccgcttctactatacaaaacagataaaagcggcgatttaaaaaagattagactacgtgtctaatcttttttttatacttgcagccggcaaatttgggataaacatacctatgtattttgcctcttccttcatttggatgattatgttaatttgatattatttcaaatttgaaagaggagtgatcgatttgcaagtaaaagaaatttttgtcattcgctgcatctcctgtttaagcgttgttttgcttcatgcgatatcaatggtgctcatggtgcgggcggacatgctcggagatgcggttttccgggttgttgaatctttcagaacgctcctgatgttcagtacgccggcgtttattttcatttccgaatttttgctcgcgcatgcctatcctggtggtgttccggaagggtttttaaaaaagcggtttaaaacaattttcatcccttttctatttatcgctgttttggatgcttttatgaccgcaggtctgatgatgcagcaatttcatgcatcggtcattattaaaaaactgttggcgaatatattcttggggaatttcatcggttacttcattctcgtcatttttcaattttacttgctgcacatgtgcttccattcatttttgcaaaaggcttcgcctaaatgggtgctttcgatttcttttgcggtcacagcggcttatttgagctatttcacgttcattcaacctccggtcgttcaggaggaggcgccgtttcctttttcgtgggtgccgtttcccggctggctcttttacttttgtttggcctattattgcggcaagaattacgagcgctttttggcattgctggaacggtacaggcatgcggtgtatgcggcggctgctgtgaccggatgtttcattgtagcggtttcctacttcggccaagacatcgcggtgacgtcaaagcgtccggatatcctgctttattcgacaagcatcattttcttatgcttccacctgttttcaaaactgaagtcggtaccgaagctgattatgatgatcagcaactattctttttctatttatttactgcacgcttttatcctgattttcgggttggtcatcttaaccgcccttgacagcatcggtacggtatcggctgttttgcttttgtttttcatttctacaggcgctgcggttttcatatcctgggccgtcaataaattgaagtacggctatatgtttgtcggaaaaatttatgtgccgaaaaagaggcgaatggagcaaaaagtgcgccatcatgcaggttaacgacataacttgatagagcgaaaagccagagcgaaagattgtatcgccggggtttttcgcttttttatattctcataaaaatgttccggttttgacacatctccttttaaatggaaggtgacttattgcctataatcatattatgataacgattatcattttcagaatacggaggcctcaacgatggttttagccgaattaaaacaaaaagagagagcaagaatcatagatttttcagacgtgaatgaacttgttcagcgcagactcatacagctcggaatgaaagaagatgatgaaatttgcgtgaagcgcaaattgccgtttggcggtccgttcatgttcgagtcaggcgggcagtgtctcggcatacggcttggagaagcaaaaaagatcaggattgaaaagctatgaacagccggcagattgcccttttcggaaacccgaatacggggaagacgtcattgtttaatgcgctgacaggctcctatgagtatgtcggaaactggagcggggtgactgttgagaaaaaggtggggctgctccgtcataaacaaggaatgatagtcgatctccccggtgtttatacattgagtccgctgtcccgcgatgaaggggttgtcacagacttcctgctcaatgattcattttcagatatattgaatattgtcgatgcatcacagttaaagcggaacttgcacttaaccgtgcagctcctggaatttgggcatccgcttacgatcggtttaaatatgatcgatgtcgcaggacagcgcggcgtcttcattgatcatcaaaaaatgtctgatgcgctaggtgttccggtaattcctgtgattgcccgcagcggcaaaggatgtgatgaactgagcaggcatttgctttttgaaaaggaaaagagggcggagccgctcgtcatcaattacggaagcgcagtggaagaagcgattggccggatcgaatcgatcatacccgaactccccggcgttttaaagcgctggatggcccttcaatatttggaaggcaactcgaaaatgaaagaacagctggaggacgcggccgacagcgaaagattaaaggaaatttacgaggagaccgaaaaacgccttcatcaggagcattccgtaagatcgctgcatcagcatatttacaatgagagatcgcgatggattgaccgcatcttgtcaacttctgtgcaatatcagtcagagcgaaaactgacgctgactgaacgcgtggatcagatcgtaacgcatcaggtgcttggcatcccgatttttttgttgttcatgtatctcatgttcatgctgacgtttgattggtttggcgttccattgtctgatgcactggacggtttcatcgggggaccgctgacggaatggacggcctcggcgctgtcggcaatgggagccagcccgtttatcgaggcgcttattctcgatgggattattgccggtgtcggcggtgtgctcgtgttcgtcccgcagatctttatcctgtttttcttcatttcggtgcttgaagattcaggatatatggcgcgtgtggccatggtgatggaccgcctgatggaggcgatcggtttaaacggcaaagcctttattccgctgattatcggcttcggctgcaatgttcccggcgtcatggctgcgcggactgtagagcagcctaaggaaagactcttgacgattatgctgacgccatttatgtcctgttcggcaaggctgccggtttatgctctgtttgcaggggcttttttcgcggcccaccaggctttcgtcgtcctttccttgtatgtgctgggcatcgccgcagcgctggtgctggcgaagtttttatcctcatccaagctcaaagaagaaaagtcgttcttcgtgattgaactgccgccgtaccgtttgcctcaagcgcgtacattgtggcgggcaacatgggagaagggcaaaggcttcgtccgcaaagccggcacttacatttttggcgggtctgtcctcatttggcttctgtcgtatacgggacccggcggaacggacgttgcgatggatgacagttttttagcgatgatcgggggagtgctcgcaccgctattgctgccgctgggattcggcacatggcaggcagcggcatcactattaaccggttttctcgcgaaggaagttgtcgttgcttcgatgagcatcatctattttgtacccgaagcccagctgcaaggcatgatggctgaacaatttacaccgttggccgcttacggatttatggctttcgtgcttttatacgtaccatgcctcgcgacagtagcggtgattaaaaaagaaacaaactcgaaaaagtggatgttcttgtccattgtttacggactggccattgcatatgcgatcgcgttcctgatttatcagggcggacgactgcttgggttatcataggaaggatgtgacagcatgctgtttaatattacgatcggagcgcttatctttagttatgcggcatggacgcttataaaatttgtcaaacgaagccggaaaggaaaatgcgccgcctgtgaattaaatcgcacctgtcaatcggcttgtgatgatgtaaaaacgaaaaacagctgagggatcagctgtttttcatttttatatgttcacctcactcatcaaagctagggtatttccttcggtatcttcaaagaaggccacccaggtttccgtttgctcgattttcgccaccacatgcggctctattggaaaagagacgccttttgttgcaatttcatcatatacagccggcaaatcttcaacttgaaaataaatgacggagcctgcatgagcaaattcgtctttttccggaaggctgagaagaagccgcacttcgccgcactcaaagaaagccatgcgatctgtctgaaataaaagggacaggcccaatacatcctgataaaatgccgcagcccgctccaagtcttgaaccggcaccccgatttgtccaaccttttcaattcccatcatcatctctcctttttttgttattattttcattttcacacacttgattccatatattttttcgatgcattttttgtttcacgtgaaacaggagtgatgggctgaagcagcggcatgcgtgtcaaatcattgtttttatggatgattattgttaacatggcttctgtttctcttaatggaaaacaatagaaaggaggcgaacataatgaatgaaaataaaaaggctgaacaggagagaaaaattggatttgaagggtttgtgctccttctttcactgatttttatttccatttttatcacgacagcatacgaaataccgagcaatctgttgctgatcattctatttttcatcggcagcggctactattctattaggctcgtgagcaaaggtctgttgagaaaaaagaggggactcggctttaaagctgcgttttctgcctttgtcgtttggatggcattatcttttttgtttcatgacatttcatatccatttagtttgaaagggttattatttcaaatcatgatgttttttcttttctacattcctttctatttgatctttcaatttgcttttaggttttcaagcattcaagaaagaaaacaataaaaaaagctggaaattccagcttttttacttattctccttttcgcgcttcaccagcatctccgtaatcaaatcaacctgtttgctgacagagatcggatcgtacggatagaacgtgtcaaagtcgttgataaagacacggttgtttttgacggcgtcaaggtttttccaaatggaagactgcttcagcttgtccagcgttttgctgtcgccgttcgggttatagtctgtcacgaacatgtagtctgctgcatattcaggtacgacttccaaggaaagttctttgatttcgccttttttgaagatgtctttttgaatcttttcaggcgcctttaagccgagcgcgttgtacacggcttggcctccgcggccgccgttgtcattgaacacccagaattggcctttttctgtgttttcataaataccgaaagtagcatttttgtcgacgacttgagcgatttttttcctcgctgctttcgatttccggtcgaaatcggcaaggaattgttcagcttcttctttagctcctgcaatgtcgccgaacatcttaacagtttcctgaacatttttcgccgtgttataaggaatcacaacagtcggtgcgattttggacagtttgtcgtaattatcatcgttcatcacgacaattaaatcaggcttcagcttcatgactttttccacattaatcgggtcgcctaaatccgttacatctttcatacggtcctttaaaaatggattggagaaagaccacgagccggagccgacgacattggcgccgaccgtgaacagttcaccggcataaaagtctgtcacgatgcgctttggatgtgttggaatcttcacgcttccacgcgttgattgatatgttcttgtcgtttcttcagccgctttttctttgctaccgtttgacgcattgccgcttccgcaggcgctgaccactatacacaacagcataactaaaccgattatcaataagttctttttcacttgaccctcctgttgatgtgaaacatatgacatttcctaagtgataatgattcgcattatcaatgtaaatatagcagatcaatccctctctcgtctatcactttttttgctaagtatgattagtgtggttttggttaatttgttactataaacagaaaaaggactgatgagagatggcagaaacgaacccggtgatcaaaaaattgcagttcaaggataatggacagcctgtactgattgtgaatccgcctgaggcatacagcggcgtcatcgctgaatttcaaggccctgttcatcatcacgccgaatcggaccaatatgattttgttcaggtattcgcagcgaccaacgcaaagctgcaggctttagccaaggaggctgaacgtcatttggcggaagacggtctgttttggctttgctacccgaaaaaatcatcgaaagtctacaaaggatcggactgcagccgcgatacagtagccggactgcttgcagaccagggctatgaaccggttcgccaaattgcaattgatgaagactggtctgcgctcagatttcgcaaggcggaaaacatcaaaacgatgaagcggaaatttgccgtaacagagaaaggtaagcagcgtacagatcaagaatgattatatacgcctcctttcagggggacgaatattcagcttgtgaacgaaagtacacaaaaaagaaataatattatgttcaatgattcacaaactttttgtataatgaatctaatcttttaaaataccatagaaaagaggtatgcagcatgaagaaatgggcatttgtatcagactttgatgggacgatttccaaacaggatttttactggatggtcattgataaatattttcccgaaggccgtgaattgttcaagaagtggaagtccggagaattaaaagatatcgaatttttgggaaccgtttttgcttcgattaatcaaagcgaacaaaaaatcattgatgacatccattccataccgattgatgaatatgtgcctgacttcattcagcatgtccagaaaagcggcggcgacttctacattttaagcgccggcacggattattacattcattatattttaaagaaatacgggattacagacgttgaggtctattcaaataaaggcttttttaaagaagacaatgttcatatggacattgatgagaatcattggcattactctgagcgctatgggattgataaatcaaaggtcattcaaaagctgaaagaagagtatgagacggtttattttgcaggcgacagtgaaccggattcgcacccggctaaatttgcggatgttacgtttgcaaaggatgcgctccaggatttgctgcgtcagcagggggtgccatttgtagccgttgaaacatttgaagacattgaacaatatcttaaagaaaaagggcggatcgtctaatgccgcgccaggttaccagcatagccatccccgcggttttggacattagtgagggcgtgcttggccggttggatgagatattgagaaaacatcagtttgacaaggcgatcatgttttttgacgatttttcctatcagcagtatgagcattcactgaaaaccgcatttcaacatgttaaagttgaagccgttctgctgccgtccaatctggacatacaggagcttttgaagcgggcattttcgatcgggaattgcgatgtcattattgccatgggcggcgggtatgttgtggactgcggaaaatacatcgccttttccaagcggaccccgttcatcagcattccgacgtcggcatccaatgacgggtttgcgagcagcaattgctcgcttcaggtcgaaggaaaaaaaacaaccgttccggcaagggttccctacggaatcatagctgatttgagcattattcaaaaagcgccggattgctttattttggcggggatcggagatttgatgtccaatattacggccctttatgattgggagtttgaggagcggcacggggtcggcgatgtaaatgcgtttgcgtcgatgctcagcaagaaagcggtcaacagctttgtccgtacgccgatgcaggatattaaacagccgatcttcttaaaagagcttgtcagttctttgacaatgggcggcatcgctacggaaatcagcggaaacagcgcgccgatcagcggttctgagcacctgatatcccacgccttggacaaaatttcgaaaaaaccgcagatgcacggcattcaagtcggggtagccacctacatcatggcccatgtacaggatcaccgggctgagcggattgaaaaggtgtttacgagaacgggctttttccaatatgtcaaaacgctgaatctgaacaaagatgagtttcgcgaggcgatcaatttgtcgcacactgtcaagcccaaccgctatacgtacttgcatgaagccggctatcgcgaaaaagcgcttcgcattcttgatgaagatccgattctgcaagaaatattttaagcaggccaagcttgcccgaaaaacgccttatttgctgtaaggcgttttttccgtgggcatcagatgaaaatgaccgggaaaagctgtgatacaataaagaaggtatgggtcataagtacgatgttagggctcgattctgatcagggagagtgtaaaatgtacaaactaatcgcgatagatatggatggaacattgttgaatgatcttcatgaagtaacagaggaagtacggaatgccctgcatgccgcgaaaaaacaaggcgtaaaaatcgttctctgcacgggccgtcccctcggcggtgtaagccgctacctggaagaactgaatttaaatgaagacggcgattatgtcatcgcctataacggagcgctcgttcaaaatacgcatactcaggaagttgtgtcagaactgacactgggctatgatgatgtgaaatcgttatatgagctcagccaaaagcttgatactccgatgcacttttttgattcggcttatttgtatacgccaaaccgggaaatcagcccgtataccgtttacgaatcatacgtcaccaaagtgccgctccggttccggacgatcgaagaaatcccgcaagatcttctggcgccaaaggcgatgtacattgatgagccggaaaagctggaccggacgatcgccgcaataccggaagacgtcaaggaacgctatacaatggtgaaaagttcgccgttcttttatgaaattcttcaccctgcggcaagtaaaggaaatgctgttcagcagcttgccgacatattaggcatcgcgcaggaagaagtgatgtgtattggagacaacggaaacgacatgtccatgatcgaatgggcgggttgcggagtcgccatggggaatgcgatccctgaggtaaaagcttcggccgattacgaaacgcgtacgaataatgaaaacggcgttgcccacgccattcgtgagcttgtattgtccaaataaaaaaagccggcccttggaaaggccggcttttactcttaacggcgccatgcttcaatctgccagatatgagtcacccagtcttcataaaaagccggttcatgggatacgagcaaaatcgttcccttatagtcgcagagcgcttgctttaacgcatgctttgccgatgcgtcaagatggtttgtcggttcatcaagaacaagcaggttgctgtttgaaagcatcagctccgccagccggacctttgcctgttcaccgccgctgagcgtaaaaaggggctggctgatatgctttggcgtcaagccggataccgcgagcgtctgcctgatgtctttttccggtagatcaggatagaacgcccgcaatttttcaagcggtgtatcatgagaagctgggctttcctgcctgaaataggccgcctgtaaatgctgtcctgctgtgacgatgccgctcagaggcttgaggtcgccgagcagcgttttgataagcgtcgattttccggcgccgttttctccaataatcgcgattttatcgccccgtcttacggtcagggaaagaggcttaaataatggaactgtgtagccggcctcaagattttccgttttgagtacagtcatcgccgggtttcgccccgttttaaatgcaaagcttgggacataagaatctgtcggtttttcgattcgcttgattttgcgtaatgctttctccctgcttttggcctgtttcgcctttcggactctgttccggtcgataaacgcctctaactttttgatttccctgttctgttttgcatatgcggcttcagcctgtgccctgatttgcgcatactccttcagaaaatattgatagttgccggaataacgtttgatcacatgatgctccagatggaatgtaaccgtcgtgatttcatttaagaagcgttcgtcatgagagatgacaagaaatgcgtgctcatagtttttcaagtagccagtcagccactcaatgtgagcggcatccaaatagttggtcggctcatccaacagcagtacatcaggctcttcaagcagcagtttggcaagcagcagctttgtacgctgcccgccgcttaaagccgtgacatcctggtcaagcccgatttccgccaagccgaggccttgtgcggcatcctcaattttcgttccgatttggtaaaatcctgaagcttccagctcagcctgaagctctccgtatcttttcaggacggcttcaaggttgtctccggcatcggccattttttcggcaagcccattcatttccttttcgatttcaaacagccggccgtacgctttctccatgtactgaagaatggttgtgccttccgtcagcttggcatgctgttcaagaaagccgacccgaatgtttggctgccattcaatgtttccatgatcgggcagaaggctgcccgtcaaaatgcgcagcaatgtcgactttccggctccgtttgcaccgacaagaccggcatgttcccctttcagcaggcggaacccggcgtcttgaaagatcatgcggtctccatatatatgggtcaaattcgttacatgaacaatactcatgatgattctctccttcaggcttatttttgaaaaaacaagccatctaaagagaacagcgtgaagcatcgctatcctgtccggcaaaaaaacgggtaaggcaaactacaccttacccgctacatatttaaaatacagcaagaaaggatgtcaaatcgtatcaaactgttcccgagatggcttgtctaaaaaagggcagacttctcccgtctttaagccaattctcttttaagaacagttgataagattttcattcctttccacctcattttggtcaaatttaccttcacaacacattatatgaagcggaatgccgcttgtcaaaccgctgccttatcaattgacatcgtgtaggcagtgtgttatttaatttgtgaacagaatcgaacgatatatgtatatcatatgagcaaaagaggagagggatagatggctaagagagaattcaaagcagaatccaagcgattgctggacatcatgatcaactcgatttattcccaaaaggaagtctttttaagggagctgatatccaatgcgagcgatgccatcgataaaatctactacaaagcgctgacagatgattcactgacatttaacaaagacgattactacataaaaatctccgcagataaagaaaacagaacgctgaccattgcggacaccggaatcggcatgacgaaagaagagcttgaagagcatcttggaacgattgccaagagcggctcgcttgcgtttaaacaagaaaacgaattaaaagacgggcacgatattatcggccagttcggcgtcggtttctacgccgcttttatggttgcggacaccgtcaccgtcattacaaaagcccatggcagcgatgaagcgcatcaatgggaatcagccggagccgacggctatacaatcgaaccggctgcgaaagaatcagccggaaccgatgtcattctgaagctgaaagagaatacagacgatgaaaactatgatgaatacctggatgttcatcgcttaaaagcgatcatcaaaacatactctgatttcatccgctacccgatcaagatggatgtcgcggtcaacaagccgaaagaaggcgccgaaaatgaatttgaagaagtccaggaagaacagacggtcaacagcatggtgccgatttggagaaaaaacaaaagcgaactgaaagatgaagattatgaggcgttttataaggaaaagcattacggttttgacaagcctctcgcgcacatccatacaagcgtagacggcgcggtgagataccatgcgattttattcattcctgaaaatattccgttcaactactacacgaaggaattcgagaagggtctggaactgtattcgaacggtgtgctgatcatggaaaagtgtccggatctgctgcctgaccatttcagctttgtcaaaggaatggttgattcagaagatttatcgctcaacatttcgagggagatgctccagcatgacaggcagctgaagctgattgccaaaaacatcagcaaaaaaatcaagaatgagctgaagagcttgctgaaaaatgacagagaaaaatacgagtctttttatcaatcgtttggcagacagcttaaattcggggtatacaatgattttggagcccataaagatctgttgaaagacctgctgcttttctattcatcaaaagagaaaaagctggtcacccttgaggaatatgtgtccagaatgcctgaagatcaaaaatacatttattatgcatcaggcgactcgtatgaccgaatagaaaagcttcctcaaaccgagctggtttcggaaaaagggtatgaaatcctttatttcaccgaggatatcgatgagttcgccatcaaaatgctggcgaattatcaagagaaagaattcaagtcggtatcaagcggcgacctcggaatcgaaaacgatgacgagcaaaaccaatctgacggggatgacagccaatacaaagacctgtttgaagagatgaaaaagactctggatggaaaagtgaaaagcgtgagggcgtcaaaacggctgaagactcactccgtatgccttgccgctgacggagaagtcaccatcgagatggagaaaatcttaaacgcaatgcctgacaatcagcatgtaaaggctgataaagtattggaaatcaatacaaaccacgaagtcttcaaaacattgcagaatgcttttgacaacgacaaggataaattcaaactgtacaccggcctcctgtacaaccaggcgctgctgatagaaggcttgccaattgaagaccccgtcgaatttacgaacgatatatgcaaagtaatggcataaaaataaaaaaagatacatctcagcttcttgcgagatgtatctttttttgatgttaatgcttcacaacttcctgtccccgcacattccaagtcatcgcaaatatgagtgctgcgattgcacatgaagcggttaaaagcgtaaagcccgcattccagccggatgcatcgacgataacacccatcagcgcattcgccgtcaaggttccgcccaggtaaccgaacagaccggtcaatcctgcagccgtgccggccgcttttttaggaacaaagtcaagcgcttgaaggccgatcagcatgacgggaccgtaaatgaggaatccgatcgcgatcaatgatgccatgtcgatcatcggattgccggctgggttgaaccagtacacaagcaccgcgatcaaaacacctgccataaagacaaagcctgccggtccgcggcgtcctttaaaccatttgtcagagatccagccgcacagcaatgtccccggaatccccgcccattcatacagaaaataagcgacgcttgatttgctcatgtcaaagcctttttcttcgcttaaataggttggagcccaatccagaacgccgtagcggacgaagtacacgaaaatgttggcaagtgcgatcgcccacacccatttattatttaatacatgtttgaaaaggatttctttcgttgataattccttttcaaaggttttcttcgatttgcttgaataatcgttgcggtattcctcgattggaggaagtccgacagactgcggcgtatcccggatcagccagtaagaaatgacggcaacggcgatggcgaccaaggccggcaaaataaacacaccttcatagcctgtagcagatcccgttatgcctgagaagatggcgacgccggcaacggcaatcggcgccatcagtcccccgccgacattgtgggcgacattccatatggcggttttatttcccctttcgctgacgctgaaccagtggacaaggacacgccctgacggcggccatcccatgccctggaaccagccgtttaagaacagcatgataaacataatggcgatcgatgaggtgaaaaaaggaacaaaccccatcaagaggctgatgacagcggaaaggatcaaaccggcgggcaggaacatcctcggattgctccggtccgatatcgtggccatcacgaacttgctcagcccgtaagagatggatagagcggacaaggcaaagccgagcgccgactttgaaaagccctcttcgatcaaataaggcatggcaagcgagaaatttttgcgaattaaatagtatgccgcataaccgatgaagatgccgagaaaaacttgcagtctgaatttcttatattccgaatcaatttgatcttccggcagccgctcaatcggcggtgctggcttaaacagttttaacatggtattccccttctttattcatttacttcttttcgcgcaaaacatcgcgcagccggtccggaaagttggtgaacattccggtcgctccccaatcgagcagccgcttcatatcttcttttttattcacagtataaggatggaccagcatgccggtgcgtcgaatcttttgcacgtatgcccggccaatgcggtcaaagttcatgccgagtccgacgctgtaagattgatattgttttaattcggcgtcagtaatggcagcaggtttgtcgtaccataataattgcactagcggaatgtttggattagcgttatgaatgatttttaagctttcaggactaaaagattgaatgatgactttgcttgaatgaatgtctgctccggtcaatttgtattgcttcaggatgtccaggagcttttcttccatatgatcatagtcttccggtgattttgtttcgatatagtagcgcgcgcttctcccgaatgtttggatgatttcttcaagggtgggcactttcagcccggcgtactccggttttgcccgctcaggatatgcttcgttaaaccaggagcctgcatcaagctctttgatttctttcagcgtatagtctttgacaaaacccgtaccattagtcgtacgatccaatgtctcatcgtgcatggcgaccaagtggccgtcttttgtcatttgaagatcgatttctatgtaatcgcctttcattttttgtccaagcttataagccaaaagcgtgtgctcgggagcatgccccgatgcgcctcggtgcgcgacatttagtagcttgttcggattgagctgcggctgggaatggcttgccgcctccgcatgcccgctgaatccaaaaccaaaaggagcgattgcggccgttataaggaagatgctgcggactagtcttttcataacatgacctctcctttcaagctgttatacagaataaaggtgccgtctattcattacgattgctttcgccccctcttagatgacgaagaaaaagagatccacaaaaaaacccctggcacaagagggtcttattgtgaatctcccattctccgtcacttgtattaacttctttcctatcatatcaaaaatggaagcgctgtcaacaagattttaaaaataaagaaacctatcttttaagataggtttcctgatcatttagcgggcaaacagccggtcgatgaaatcaatgtcctcttgagacagattgacttctgccgttttgaggttgtcgatcagctgatcagcgcgtttggcgcccgggatcaacacgtcgatttcaggccgcgccaagtaccaggccaagacgatatgggcgatgtcgacattatgtttttccgcgatcggcgcaagctggttcacttttctaatgttttctttgaagcgttcgccttggaagttttccatttctcttctcaggtcgccttccgggaacgttgtatcttcgctgtattttccggcgagcaatccggagacgagcgggaagtaaggaacaaatgagatgttatgctcctgtgtatacgggaagaatgtcgtctcagcttccctgttcagcaggttgtattcgccttggagcacatccaccaatccgtctttgttcgcttctttcagctgctcaagagaaaagttggatacaccgattgctctgattttgccttcctgcttcagttcatggagcgcctgaaccgcttcgtctttcggcgtattttcatcaggaaaatggatatagaaaaggtcgatgtagtcagtttgcagccgcttcaggctttcttcgacggactttttcaaaaatgcgggagagttgtcaaagacaaaatcgtctccttctttcttatgggcggcttttgttgcaatcacgacatcttcgcggttgaattctttaaggacttcgccgattaattcctcggaacggccgatgccgtatatgtaggcggtatctaaaaaagtgacgccgtttcttattgcttcccgcaccaattcttttcccgtttcttcattgagattcggataaaggttatgtcctccgacagcattggttcccaaaccaatcggaaatacgtgcaagtctgatttgccaactttaacttttttcattgaattcccctcctgatatgatgtgtagataaataaacttggccggccgcttggaaacagccggtcaagggcgtccgcttcaactatacatgttttgccaaatggatttcaattttgcgatctttacagtacacgtgatattcctcatcaagcgcctgagatgtgacgatcgcgtgcaatctgtcaaacggcgcgtacgtcagcagggtcgacttcccgaatttggaatggtcggccagcaaatatacttgttttgctttttcggatattttctttttaatttcatattcaagcagatcggagtttgtcagtccatgggtaagtgttgcgccggttgccgacatgaaagctttattaatattatatttatccagcgttcccggatcatccatgccgacgaaggactgcgttttccgtttgtagttgctgccgatgatgatcaagtttatattttgcatcgctgcagcagcgttgataatgtcgaggctgttcgttaaaacggttacatttttatttggatcaagagtttccaatatggatcgggtcgttgtgccggaatcaataaaaatcaggtcatggtcttcaataaagcgtgaagcatagcgcgcgatttttgtcttggcatccttgttttgaatggttctgttttcaaaagggatcaaggccgttttttcgatcgctgttacgccgccgtagactttttttataactcctttctcggtcagcttgttaatgtcgcgtctgaccgtgttttttgaaacattaaagacctggcatagttcatcaagcgaaacggtgccattggtcaaaatataatcttccatttctttaatccgcattaacttcatactaagtatctccttctagtatatttgactaaatatatatgatgaacccaaaagttaaccaataattgcttaaaaaatgataccattggtgattattttttgcaagatttgccctgtttctttttattatacaatgtttccctaaatcattttaacgttttctacaaatcttacaaaagaaaaatttaatgattttgattgacttatgggtaaggccggattaaaatataaccaataagtgaccaaaacgtgataatgttgagaaatttctgatgtgtaaacgttttattgcgtcatggttctttggataaaatcatagttctattcattaatttcttttgtaagcgtttaattcctgttttttgcgaaaatccgttgtgcaatgaagagctgttcggcattcatacataatggttgaaacctgccccatctgtaccaggagatgtttaatattcaaggaggttataagaatggcagaaatcagaaagttaagaaactatattaatggagaatgggttgaaagcaaaaccgacaaatatgaagatgtagtcaatccagcgacgaaagaagtgctgtgccaagtgccgatttcgacgcgagaagatatagaatacgcagcgcaaacagcggctgaagcgtttaaaacatggtcaaaagtggctgttccgcgccgggcaagaattctatttaactttcagcagcttttaactcagcataaagaggagcttgcccacctcatcacgattgaaaacggaaaaaacacgaaagaagcgttgggtgaagttggacgcggcatcgagaatgtcgagtttgcagctggagcgccttcactgatgatgggagattcacttgctacaattgcaaccgatgttgaagcggcgaactaccggtacccgatcggagtcgtcggcggaattgcaccatttaacttcccgatgatggtaccatgctggatgttcccaatggccattgcgttaggaaacacatttattctgaagccttccgaacggacgccgcttttgacggaaaagctagttgaactgtttgaaaaagccggacttccaaaaggggtcttcaatgtggtatacggcgcgcatgatgtagtaaacggcattctcgaacacccggaaattaaagcgatttcattcgtcggttcaaaaccggtcggagaatatgtctataaaaaaggaagcgaaaatctgaaacgcgttcaatcgctgacaggcgctaaaaaccacaccatcgttctgaacgatgccaaccttgaagatacggtaacaaatattatcggcgctgctttcggatctgccggcgaacgctgcatggcatgcgcagtagtaacggttgaagaaggaattgcagatgagttcatggaaaaattggttcagaaagcatctgaagtcaaaatcggaaacggacttgacgacggtgtattcctcgggcctgtcattcgcgaagacaacaagaaacgcacactcggctatatacaaaaaggaattgaagagggtgcgagacttgtctgcgacggacgcgaaaatgttacagatgaaggctatttcgtcggcccgacaatctttgacaatgtcacaactgatatgacgatctggaaggacgaaatttttgctcctgtactatcggtcatccgtgtgaagaacttgaaagaagcggttgagatcgccaaccagtccgaatttgcaaacggcgcatgcttgttcacatcgaattcgaatgcgatccgctatttccgtgaaaacattgatgcgggaatgctcggcatcaacctgggtgtaccggctccgatggcattcttcccgttctccggatggaagtcttcgttctttggtacattgcatgccaacggaaaagacagcgtcgatttctatacgcgcaaaaaggtcgtcactgcaagatatccggcgcctgacttcaattaattgtgaaaaaaccggggggtgcggttcccgcgctgttcggatcatgtttcaagtttgaaaaggaggctttatccatgagtcatttgttgcgcaagccgcaggcgaatgagctgtcacaaggcgtgaagcttgtacacgaagtgaaaaaatcgaattccgatctaagttatgtcgagtttaaagtccttgatcttgcaccgggatccagctatgaagaatcgctgagcaaacaagaatgctgcatcgtcgcgcttaccggaaagattaccgcaaccgatcatgaacagacatttgaaaatatcggcacgagagaaagcgttttcgaaagaaagccgaccgacagcgtatatgtgtcaaatgaccgcaagttcggcattaccgccgttacagaggcaagagttgccctgtgctattcaccttctgaaaaccagcttccgacgaaactgatcaaagctgaagacaacggtattgagaaccggggaaaattcagcaataaacgaaccgtccataacatacttccggattcagatccttcagcgaacagtcttttagtcgtcgaagtctacactgaaagcggaaactggtccagctatccgccgcacaagcatgaccaagacaacctgcctgaagagtcctttttagaagaaacatactaccatgaacttgatccgcagcaaggcttcgtatttcagcgcgtatacacggatgaccgttccatcgacgagacgatgactgttgaaaatggaaacgttgtcatcgtgccggccggataccatcctgtcggggtgcctgacggatacacatcctattatttaaacgtgatggcagggccgacgcgtaaatggaagtttcataacgaccctgaccatgaatggattttggaacgctaacaataaggcaaggagaggctgttgaagatgaagtatacgtttaatgaagagaaagaatttgacattgtagcgatcggccgcgcatgcatcgatttaaacgcagtcgaatacaacaggccgatggagcagacgatgacattttcaaaatatgtcggcggctccccggctaatattgcaatcggcagttccaaattaggcttgaagaccggatttatcgggaagattccggatgaccagcacggcagattcatcgaaacctatatgagaaatacaggtgtcgatacgtcacaaatggcggttgataaagacggacataaagctgggcttgctttcacagaaattttaagccctgaagaatgcagcattttaatgtacagggatgatgttgcagatctttaccttgccccttctgaagtgaacgaagactatattgccaaatcgaagatgcttcttgtgtcaggtgcggcgctggctaaaagcccttcccgcgaagcggtgctgaaagccgtacagctggcgaaaaagcatcaagtgaaagtggtctttgagcttgactatcgtccatatacgtggacatctgcggaggaaacggccgtctactatacgcttgttgccgaacaatcagacattgtcatcgggacgcgtgatgagtttgatgtaatggaaaataagagcggcggcagcaatgaagaatctgttcagcatttatttgcacattccgcagatcttgtcgttatcaagcacggtgtcgaaggttcatatgcatacagcaaatccggggacgtcttccgggcgaaagcgtacaaaacgaaggtcttgaaaacgtttggagcgggcgattcatacgcctccgccttcctctacggactcgtttcaggcaaagatattgaaaccgcgctgaaatacggaagcgcttccgcctcgattgttgtttcaaagcacagctcatctgaagcgatgccgacagtcgccgagattgaagagcttattgcggctcagtcttaaatgaagaatatgaataaaggtgggatcgtttgtgggcaagaaaatacgtttaaccacagcacaagcgttaattaagttcttaaatcagcagtacatccatgtagatggagaagaaactccgtttgtcgagggaatctttacgatttttggccatgggaacgtcgttggaatcggccaggcgcttgaacaggatgccggccacttaaaggtgtttcaaggcaaaaatgagcagggaatggcgcatgcagcaatggcttacagcaagcaaatgctgagaaggaagatctatgccgtgtcgacatcagtcggaccgggagcagctaaccttgtggcagccgcaggtactgcgcttgcgaacaacattccagtcctcttgattccagccgatacatttgccacgagacagcctgatcctgttcttcagcaagtagagcaggaatacagtgcggcgattacgacgaacgatgcattgaagcctgtttcgaggtattgggaccgtattacgcgccctgaacagttgatgagcagtctgattcgcgcttttgaagtaatgacagaccctgcaaaagctggtcctgcaacgatttgcatttctcaagatgttgaaggcgaggcctatgatttcgatgaaagcttttttgaaaaacgcgttcactatgttgatcgcaaagagccgagcgagcgtgaactgaagggagcggcagaactgatcaagtcgagcaaaaaaccgctcatcttggtcggcggcggagcgaaatattccggcgcgcgcgacgaattgatcgccatgtctgaagcttacaatattccgctggtagaaacccaggccggtaaatccacagtagaagccgattttgccaacaatttgggcggaatgggaatcaccggtacgctggcggcaaacaaagcggctcgcggggcagacctgatcatcggaattggcacgcgctataccgattttgcgacatcatcaaaaaccgcttttgactttgacaacgcaaaatttttaaacattaatgtcagcagaatgcaggcttataaactggatgctttccaagtcgttgccgatgcaaaagtaacgctcggcaaactgcacggcttattggaaggctataagagcgagttcggttcaaccatcaaggagctgaaagacgaatggcttgctgaacgcgaccgcttaagcaaggtaacatttaagcgcgaaaacttcactcctgaaattaaagatcacttttctcaagacatactcaacgaatatgcggatgtgctgcaaaccgaactgccgcaaacaacggcattgctcgccatcaatgaaacagttgatccggacagcgtcgtcatttgttcagcaggctctttgccgggagatctgcagcggctgtggcattcaaacgtaccgaatacgtaccacctggaatacggctattcctgcatgggatatgaagtatcgggaacgctcggcttgaaattggcgcatcctgatagagaagtttattcactggtcggagacggaagcttcctgatgctccactcagagctcattacagcaatccaatataataaaaaaattaacgtgctgctctttgacaactcaggattcggctgcatcaacaatctgcaaatggaccatggaagcggcagctactactgtgaattcagaacagcagacaatcagattctcaatgtcgattatgcgaaagtggccgaaggctatggagcgaaaacctacaaagcgaacacgattgaagaattaaaagcggcgctggaagatgccaaaaaacaagatgtctcaacattgattgaaatgaaggtgctgccgaaaacgatgacggacggctatgacagctggtggcacgtaggtgttgcagaggtttccgaacaggaaagcgtgcaaaaggcgtataaagcaaaagaaaaaatgctggaatctgcaaagcagtattaaaggaggcaccaggatgggcaagacacaaattctatggggcatcgcccccataggatggcggaacgatgatattccggaaatcggcgcgggaaacacacttcagcatttgttgagcgacattgttgttgcgggctttcaaggcacggaagtgggcggcttttttccggaaccggccattctcaataaagagctcgagctgaggaatctaaggattgccggcaagtggttcagcagctatatcattcgggacggcattgaagaagcagccaaggaatttgcggctcactgccagtacttaaaagacgtccatgccgatgttgcggtcgtatcagaacagacgtacagtgtgcagggcttggataaaaacgtgtttaaagaaaagccttatttcaccgatgaagaatggcagcggctatttgaaggtttaaatcacctcggggaaatcgccggccgttacggactgaagcttgtctaccatcaccacctcggcacaggcgtgcagacagaggaagaggtggaccggctcatggcgggaactgacccggcacttgtgcaccttctgtacgatacggggcatgcctacatttcagatggaaattatatgaacattttagagaagcatattgaccgtattaggcacgttcattttaaagacgcgcgccttaagatcatggagaaatgcaagcgggaaggaaattcgttccaacaggcgtttctgcaagggatgttcacagttccaggcgacggctgcatcgattttagagaagtatatcaaacgcttttaaagcacggctattccggctggatcgtagtggaagccgagcaggatcccgatgttgccaacccgcttgaatacgcattgatcgccagaaagtacatcgatcgtcacttgttgaatgtcccagcaaccaattaagggggctctaaattgagcaatggaagtgcagcagtctcaccattcaataaacgaaccgtcgcagcagctttggcaaattacattgatgcaggctccattgtcgcaggatcggcaggattatctttatgggtcagttacctgaagctttctgatacacagatcggactgctcggcgcatttagcgccaacgccatttcggcagcaatcggagcgctgctcggaggctttttggccgacaaaattggccgaaaggctgtctatacgaacagtatgctggtttatgcactgggcatttgtttagttttattcggcaccagcttcccctttttgttaagcggttacattattatcggtttatcggtaggagctgatattacggcttcctggacgatcatcgcagagaacgcacctaagaaaaacagggcgcgtcattgcggggttgcacaggtcgcatgggctgcgggagcggttgtggttctgctgctgtcggtcctgctcggtgatttaggcttattgggcaataaaatcgtgtttgggcatttgctcgttatcgcactgattacttatgttctgcggaaaaggctgccggaatccgatgcctggcaggatcaatccgaaatggctcaagccgtcaggaagccgaagacgccttatctcgatttgcttcagcctaagtatttgaaaagcattttattcttaatgggcgtgtacttggtttggaatctggctgcaggtgtcatggggttttttatgccttacatttatcagcaggtcggcgatgtatcagcgaccatggcaaatattttgcagatggggctgtttattttcaccgggcttggcgtcgcttttatcttcatgccgtttgcagacaaatacaggaagacagtgtttgggatctccgcatttgcggcggtgatcggctggtcattgtttctgcttccggcagagggcatgccgattctcatcctctttatcgtgatgatcggcataaacaacggggcggggcaacaggccaactatcaattatgggcgagtgaaattttcccgacggaatatcgcgcatctgcacaaggattgatgttcttccttgttcgtatctcaatcggggcttggagccttttcgttccaatgatcatctcgaattttggaattgcatttatggcggccattctccttggatgtgtaacggccagcatgctcatcgggctcttttttgcaccgaatacatccggtaagtcgcttgaacaaattcaggaagagctgtatgggactcctccggctcaagctgggcaagtgcaaacaagaaaaattatgtaactacatttgaaggagtggctatcaatgaaactacgcattggtgttattggtacaggagcaatcggaaaagaacacatcaaccgcatcacaaataaattagccggcggcgaaattgtcgcggtcaccgatgtgaaccaggaggcagctcagcaagttgtaacggactacagcctgaacgccaaggtctatccggatgacgacagtctaatcgcagccgaaaatgtagacgcagtcttagtaacaagctggggaccggcacatgaatcaagcgttttgaaagcgattaaagcaaacaaattcgtattttgcgaaaagcctctggcgacgactgcggaaggatgcatgcggatcgtcaatgaagaagtcaaagcgggcaaacgtctcgttcaagtcggctttatgcgccgctatgacagcggttacgtacagctgaaagaagcgatcgacaatcgggttatcggcgagcccctcatgatccactgtgcgcaccgcaacccggttgtaggcgacaactatacaacagatatggctgtcgtcgatacgcttgtccatgaaatagacgccctgcactggctgattaatgatgactacgaatccgttcaggtcatttatccgaaaaaatcgaaaaacgcgcttcctcatttgcgtgatccgcaaatcgtcatcatcgaaacaaaaggcggagtcgtgatcaatgcggaaatctatgtcaactgcaaatacggctacgatatccagtgtgaaatcgtcggcgaggacggaatcgtgaagcttcctgaaccaccaagcatctctctcagaaaagacggcaaattctcgacggatatcctcatggattggcagcgccgctttgtagacgcttacgatgtagaaattcaagatttcattgactcgatccaacagaaaggcgaggtcagcgggccgactgcgtgggacggctatatcgccgccgtgacgacggacgcctgtgtgaaagctcaggaatccggacagaaagaacctgtggcgcttcaggagaagccggaattctatcaaacgttcacaactgttaaaaaataaaaacattccgaggagtgaaaagtatgaaattagcattggatccatcgatgtatcgtgatgatttgactttggaagaaacggtctataaaacggcggagcttggctacgaatatatcgaactatcgccgcgcgaagatttttgtccattctataaatatccgaaagtcgattcagctaaaatcaaacaattaaagcggcttttaagagataccggtgttaagctttcatcgctccttccgctttaccactgggcaggtcctgatgaagatcgccgtcaggccgccgtgcgcaattggaaaagggcaatcgaaattgcggtcgagcttgaagtcgatttgatgaacagtgaattcagcggttcaaaatacgatcctttaacaagtgaagaaaaatttatcaaatccatggatgagcttctgccaatctttgaaaaagaaggcattaaactcaatcttcaagcccatccatacgattttatcgaaacgcacaaaggtgcgttggatatgatccgcgcgcttgacaaggattggattaatcttgtctactcgactgcgcatacattcttttatgatgacggcaaaggcgacatcgagacaatgtttgacgaagccggcgaccgcctcacacatgttttattcgcagatacgtataatcataaagcggctcatggccttcgctacatcgtcaatccgcctgacgcaaaagtaacggttcaccagcatttggacattggtcaaggcgaggtcgattttgatacgatcttcagaaagctgagagagatgaagttcgacggaattgcgacgaacgccgtttttgcttgggtcgatgaaagagcggatgaatcaagcagattcatgcttgaaaaattgaaacaagaattattaggctaagcccccccctgagttcggcgccctgccgaacttctcttcacaaggatatgagagaaggagaatcgaatatgaagctatgctttaatgaagcaacgacgttggaaaattcaaaccttgcaaaagacctcgaatactgtgagaagcacggatacgattatatcgaaatccggacgatggataagctgcctgagtacttaaaagaccatgctctctcagagttagccgagtattttcaaactcatcatattaagccgctggccttgaatgcccttgtctttttcaacaaccgcgatgaaaaagggcaccgtgaaatcatcgaagaatttaaaggcatgatggaaacgtgcaaaatgcttggtgtgaaatacgtggtcgcggtaccgcttgtcaccgaacaaaaaatcttaaaagaagatattaaagcaagctccgtcgaagtgctgacagagctgtcagacatcgctgagccgtacggcgtaaagatcgctgtcgagtttgtcggtcacccggagtgtacggtcaatacgttcagccaggcctatgacatcgtcatgaccgtgaaccgcgataatgtcggccttgtttttgacagcttccatttccatgcaatgggctcaagtcttgaggatttaaaaaaggcggacggcaagaaaatcttcatttatcatatcgatgacacggaagactttccaatcggatttttaagagatgaagaccgtgtttggccgggacagggagccatcgacttggatgcccacttatcaactttgaaagacatcggtttttcggatgtcgtatcagttgaattgttcagacctgaatactataagctgagcgcggaagaaacgattcgaacggccaaagaaacaacagttgaagttgtttcaaaatacttcaagatttaatacgggataggaggggtgaacgtggctttcgtttccatgaaagaacttcttcaagaagcaaaggaacatcattatgcaatcggtcaatttaatattaatggccttcaatggacaaaagcgattctagaggcagcggaagaagaacggtcacctgtcatcgcagccgcttcagatcggctcatcgattatttgggcggatttaaaacggtttccgcaatggttgcggctttgattgaggaaatgtcgatctccgttcccgtcgtgcttcaccttgaccatggcaaaagtccggagcgctgcaagcaagcgatagacgcgggttttagctcagtcatgatcgacggctcgcattcaccaatcgatgaaaatatcgccatgacaaaagaggtcgtgtcatatgccggggtccgcaatgtttcggttgaagcagaggttggcaccgtagggggcatggaagacgggcttatcggcggagtgcagtatgccgacatcggtgaatgcgagcggattgtcaaagaaaccggtatcgatgctttggcagccgcgctcggctccgttcatggaaaatatcaaggcgagcctaatttgggatttaaggaaatggaagaaatctcacgggtaacggacattccgctcgttctccatggagcttcgggcatcccggctgatcaaatcgcaagaacgatccgtctgggccatgcgaaaatcaacattaataccgaatgcatggtggcctggactgagaaaacgcgcagcatatttaaagacaatcccgatttatatgaaccccgcgcctatatgacgccagggatcagcgcagtcaaagaaacggttaaacataagatgagagaattcgggtcatccggaaaagcggtatgcacccaaaagatagaaatataagctaaaccaatatcgcctccactcacttaatcgaagtgagtgtttttttgttcgcagtatttgtaaagatattctaaaggttcaaaagtatgattgactgtaattgatataatagttataatttccctcataatccattttgatcagaaaagattttattttctgaaaataaatgacagcaagacaataactaaatcaggtgaatgctatatgctgacaaacgttttaaagtatcgggttcatattttatttatcgtgttatgtttgatcggcgggacgacatgggcttttcaaaaagccgggctgagtgacagccttccattttggtccgccggcatgcggttcatgatcgcaagcattttgatcgcggcgtttctgttggcacggaggcagtttgttctgtcaaaggaactgctagtgctgtcgtttttgaacggcatcatgtatttttccgttccattcggatctgtttattgggcctctctttatttgccgagcgggttggtgtctatattagcggcaagcatttcagtctttgccctgatgatcaaccgcctcgtcaaagggacaccggcgacgaaactgcagaaatgggggatatgcctggctttgctcggcattacaatcgtgtttggcaaccaactgctgatcaaagtcgatgttattgaaattgtcgcaatgattgtgattttgtgtgcgatgtttggctcggcttttattcaaatcaaagtacagcagagaattcgttcgcttccgatcttaagctttaactccctttcaatgctgagcggcggagcggtattgctcatcagcagcctcatctttgaaagcgggacaagaacgttttccggtgtgagtctttatgcgctgctttatttagcggttgtcggctcgattttgggtttttggatcaacatttatctgcttaaaaaatggcacatctcaaaagcgacttcccacttgttcatctcccctgtcattgcgctctatatcggatttctgtttctggatgaaaaactgaatgcgaatatttatttaggaacgctgtttgtcatattcggtgtgatgttcatcaacttaaaaaaagaagagaggatcgcgaaaattgacgaaacgaaacaaaaacttggccatcatttgtcaaaataagcacctgccatttatttttgaagaagctgagcgtttaggattgaaggtcacgttcttttacaattcggccgaagatttcccgggcaatcttccggctgtggaacgctgtgtgccgctgccgttgtttgaagatgaagaagcggcgatggatgtcgtcaggcagacatttgtcgaatttccgtttgacggcgtgatgacactgtttgaaccggctttgcctttcacggcaaaagctgctgaagctttgaatctgccggggcttcctttcacaacaatggaaaactgccgcaataaaaataaaacccgcagcatacttcagcaaaacggattgaatacgccggtttttcacgagttccatacgctcgctgacctggaaaacaggaaactgtcgtatccattagtcgtcaagccggtcaacggcttctcaagccagggcgtcgtccgtgttgatgatcggaaggagcttgaggaggccgtccggaaagtcgaggccgtcaaccaaagggacctcaatcgattcgtgcacggcaaaacgggcatcgtagccgagcaatttatcgatgggccggaattcgcgattgaaacgctgtcgattcaaggaaacgtacatgttctttcgattggatacaaagggaacagcaaagggccgttttttgaagaaggggtctatattgctccggctcaattgaaagaagagacgcgccttgcgatcgtcaaggaagtgacgggcgccgtttcagcgctgggcattcaccaggggccggctcatacagagctgaggctggacaaggatggaacaccttatgttatcgaggtgggcgccagaatcggcggttcaggggtttcccattacatcgtcaaagagagcacaggcatcaactttatgcagcttgtcttgcaaaatgcattaaagccgctggagagcagcgagtttgaaggcgagatcaggcctgtaaggacagccggcaattatatcattcctgtacagggctccggcacttttgaaaaaatcgacggactggaagaagtcaaacagaggcaggaggttaagcgggtgtttcaatttatgagaagaggcgcaaagatcctcccgtacccgcacttttccggttatccggggtttatattaacaagccatcattcttatgaagaatgtgaagctttctaccgggagctggatgatgagcttcatatcatttatcaaaataatttgacgggtacaataggaggttaagatgatctcgactaaagtgcacaaagagcaagccgtgatgattgtccatacgctcggtcccaaaggcacgaactgtgaaaaagccggcctgctatggctcaaaaataaaggggtccgcggggaagtcaggctttatgaaacgttggaagaagcgctgctccatgttaaatcgacagaaaattcagtcctcttaggctgcgccgtttacccgtttttgcatcaaatcgtatttgagaatctagcggacttaaagattatagacagttttgtgatgcctacatacaacatggtgtttgccgcaaaacagcacacgatggcatcggatattcaaatcgtcgcttcacaccctgctccggctcatctggcaaagctgttcagcagtcaagtccaatttgtcaccagcaatgctcaagcggccctggcctgcgcttcaaacgcggctgacggctgcatcacgacgattaaagcagccgatgaacaccgtttgaaagtcattaaagattttggggaagtaccgatgtgctttacaatccacgggcttaaatcaatcgaaggaggaagccgatgacgactttgacaggggacattgtaaacatggtcaacgggcagattgtaccgaacatacatgaattgcagacgtaccaaaatgataaaggacagattacagagcatcacgaaagggcggaacagcttctgctgcaattgattgaagacgcaggagccatttatgaagcggttcacttaacggctgcaaaagaggcgtttaaagaggacgttttggattggatcagccgcggattaggggagacgccgtattttgaccggttattgacggcttaccgggctccgcatgatcaggagacgaccttttttgcggtgccgatcgtgacgccgaatgggcctcatgcgaaaggctgctattttgaagcctttttagccgttcgtgaagaacctgccatgatgaggccgatagaagaggatctgcctcatcctgaaaacggctgccaatcccttaagctgctcgccggaacaaaggggttcacggaagaaaaatgcatcgtattcttccctgaaaatgtgaaaacaaaagagaaaatcacatcacagacattcgcgattttctactttaataagttttatcacatttaccatgaggacacgctcaaaagagcgagggccatttttgaacatgcgcctttcaagtcggctcagctttcccccgaccgcacatatgaagcaagggtgttgtggggctaccttcacgactattttcatcattgcggaaaaaaaccttttcatctccatattcaggcgaaaatgaattttttcgcaggcattttagaagaagtcaaggtcgattgccaagcaatcctgaccttgtgggagcggcaatatgacggctgggaggaaattatcgaatttgttttgtatgagcggctgctgcgctatccgagccagcataatgcaacgcggaattttgattccgggacaggctattttctgttcagctggatgattgaaaacggccgttccattcaaaaaggagaagagaagcgcgtgtcgcttgaccttccacgctgcatggacgatttaagaaagcttgtggccgaaattgaacagctggaagaaatcgaggatgacacggcatacaaagaggccgcggagcgctatgtcagacaatacctgcctccgggacgggaaggcgagcgattcagcgtcccggaacagtatttcattgacgagatcaataagaaaatcgaaaccgcccgtcttcgatttgaacgggagagactggaagcgtgaagccgccattaagcaaaatcggagagaaaatgattgagaaaacaggggtcagggctgtgatgagcgatattcaggaagtcctggccggcggtgaacggtcatacattaatttaagtgcgggcaatccgatgattttgcccggcgtgtcagccatgtggaagtcggctcttgccgatctccttgacgatgacaggttttcttcggtgatcggccaatacggatcgagctatggaaccgatgaactgattgcaagtgttgtccgcttcttttcagagcggtatagcgccggcattcgaaaagagaacgtgttgattacagccggaagccagcagctgttttttctggcgatcaattcgttttgcggaatgggaagcggatctgtgatgaaaaaagccttgatcccgatgctgcctgactattcgggatacagcggggcggcactggagcgggagatgattgaggggatccctccgctcatatcgaaattggatgatcatacgtttcgatatgagctcgaccgtaaggggtttttagagaggatgcggaccgatccgtgcatcggtgctgtcttgctatcgcgcccgaacaatccttgcggaaacatcttgcctaaagaagatgtagcattcatttcagacgcatgccgagaagcgaatgttccgctgttcattgattccgcatatgctccgccttttccggcgattcactttatcgacatggaaccgattttcaacgagcagatcattcactgtatgagcctttcaaaagccggcctgcctggcgaaaggatcggaatcgccatcgggccgtcccggtatattcaggcaatggaagcttttcagtcgaatgcggcgatccattcttcaaggctggggcagtatatggctgcatcagtattgaatgacgggcgcctcgccgacgtgtcgctgaatgaagtcaggccatattaccgcaataaattcatgctgctcaaggaaacgcttttatgcaagatgcctgaagacatcaaatggtatctgcatcaaggggaaggatcgcttttcggatggctgtggtttgaagacctgccggtgaccgatgcagcgctgtatgagtatatgaaagcggatggagtcattatcgttcccggatcatctttctttcaccgtcaatcccggcgcctggcgcattcacaccagtgtatacgaatcagcctaaccgcggcggatgaagatattataaggggaatcgatgttttagctaaaattgcgaagggtgtatatgagaaacaggttgaatacttataaaaaaacaggggctaaaagcaagcccctgttttattcgtcaatccctccgccggcattggcctttctttttctgcgccttgccgttgtcaagatcaaaataaccgctgccgctatgattacgatcaggatggcaatgtacagcacatgctgctgattgctttcctgtttatcatccgtcttggtttcggcggattttgctgtcagctgttgatggtttgtaaatagctgatggctgtccgtttcattcacaacggttgctgcgaaatcattgctgttcaaaaagttgatcatttcttttgtgactgctgtgccttgccctttaaacggcgcgaaaacagccatcgagtaatttgaatcccacagcgacgtttgagtaaacgcgacttgttttgtcgtttcattcagcatttgaaaagatgacacatcaaatgttccgtttttcgccgtcggaacagccaattcggctgttttttccttcagcagagagaattgatcgacgcttccgatgaagattacgtttcttcctttcacgtcatccggtttgacttccgaggatgtttttactgtgaatgcctgccgggcttcgctgccgaaggagccgactacaagcgaaagctcatcaatcttcgactgatccgcattgtcgggcaggatcatcagcgttttattgttatgatcacccgcgtagggaagcggccacgcttgaaaatctgctgaagctgacgtgtcgctgacatggtaagacaatgcactttgtttatcgataaaaatccatttgtcctcgttcaccgcgtagcaagggttgttctctttcaagcctgaagcggcaaattgaatatcaatgtaacggcttttttgcaaaagtttcggatcgacttttaaagaaacatggtaaaagccgtttttgtcttcttttcctatatcgtcaagtccgacggaatgaggctggccattgatcatgaccttcagctccgcctgttccgcagctaagtcgctttggccggcctgcttttgaatcgttttcgattttttcatcgcaagcgaaagctttgcaggctgattcttgtctaatagagctggcgcgggataataaaaatgctcggaagatgtctgtcccgaaccgattgtcaaatcccccgccccgaaatcctcaagtgtcagcttgctgccgccccgtttgctatgctgctgaagtttgccgattgccagcgtgtcgccgctgagctgggcggcatacgttttgtcggtgatgacgctgattttttcagaaagcacatcatcagatgctgcggccgcaaacaatacaggctgctgcttatcctttgctttgagcatccgtttcgcaagcaaaagcttgtcttcttttgcttcgagtttcgcttgtttcaacagctttttcactttgccgctccagtgatggtgaacgccgatcacaatcgtcggcctgtcgatcttcgccaggtcagattcacccaagatcttcgtgctgatgctgttgtcaaccgttttgaggtatgcttctgttttaactgccgcttcgatttcagccgaacttggatggtccggaatgacgattgccgttttttccacggagctgccggactgggcgaacggataaggataatgttcgagcgccgctcctttagattcgttcttttccccgatattcagacgactgtccggataaattttgatccagttcccggaggagtcctgtctgacgcagacgccttcatgaaccactccgtagaacttcagtgataagctgtgaaaccctggagacgactggcttttgttcagcgagagcttcagcgttttcttcccgttattcccttcaagcttaaccgttttgaccggttcgccatcaatctcggctgttaaagaagacggtgagattaaaaggtctgaggcctcgtatttaagtgtaagctgctgatgggtagaggaggcgcccgccggtatttgatacgtcagctcggcgctgtcttttgccccgtataaagtcaagagatcgtttgtgagcacttgctgcttggcttgttcccggctgttttcccccaggatcgagccgtctactgtaacgtctttggctgcagccgcttgtcccgtcgccgtgatcagcaagaagcttgccagacatatgatgatatatttcaaaaaagtcacccgcttttcttttgattgtatcgttctgttttgtaccatgtaacctcttgcttgaacaggcggtgcttgatttctacgaataaagaataaatcacgagcacaatccaagcctgcgagtatgtaaagtacatcagaaaaacgatgaaaaagttttgcctgttcatttctgttttttcgatgctcagtgtaatcatgacctccgtcataaatagaaagaaagccaaaacccataaaatgatagacaaaaaaccgaatgaaagatgcagattataaaataaattgatgacaaaaatcgcatttgacatgatgacgccaaagaaaaacaaaaaatacgtaaaaaagaaataaaacaaatcaaaaataatccgttttctcttcagcttgaaaaactgagccaaaaatttcaggacgacatactggttgccgcgagcccaccttgtccgctgacgccaccagactttccacgtttccggctcctgttcccaagtgacggccgccggaaagaagcggatgtggtagccgaggttgtagacccggatcgtaagctcggtatcttcggccagcgccttatcatcccagccgcccagctgttcgataatgcttcttctgatggcgaaattggtgccggggatcgtggcgattttgaaccatttccatctcccgccctgtgccatccattgaaaacaaatcgtttcgatgttaataaattttgtgagcaatgttttcgccgcattgatgacgcggaattttcccaccaccgctccggctttctgatcattcatgagcccgaggacaaggtaataaacagccattttttccggcgtgttgtcggcgtcatatacacaaatgacgtccccgtttgactcggcaaaaccgcagttgagcgccgacgattttccctttccggcatgcggcggtttggtcacgaccattttaataaagccgtattgcgtggaaaattcatccacaatgtcacccgtccggtcggatgaattgtcgttgacgacaataatctccagccggtccttcggataatagaggttgaccatcgccttcagcgtctgccgaatgacgacctcttcgttatgcgccggaatcagaacgctgaccttcgggagatccttcacgttctctttccacttcggaatgttccgttcgaaggtcatatagtggcggaatccgccctgcatcaaaaacatgtgatacagaagcatgacccatattaagcttaacgagactaggaacagaacattacccacggctttttctctccttaaagattcgtttttttaatgtggctctcaagtaaagggtatagctcacaaacatgacaacaaacaagagaacaataagagagagaatccaaagcgccttttccagcgggctttgctggtgatgatcgaaaaacgtctcaatggggctgactttgcttttgacttgaatcgttccatctccgcttgtgtgaatttctactttatctgtgttaacagtttgctttgtctttttaatatcgagccattcgctgtttggaatgcgttccatttgatcaaccagttcaggaagatatttcattccaagataaggatgataaaatgcgccggctactccgccttcaaaatcgatcatttgagagatgcgctcctcgactttgccgagcggattttgctccgattgatcgacatagccgattgtctcgggatagagcgtcatcccatggagcatggccggattcgtaacaaatggaccggcgcctgacgttttccatgttgtatcgctaagctgaacctggcccaacaagcttgtgaaatattgtgaggcgatttgatagccgtgctctgacatcgtatagtgcggcgcttcaaacgcgagcggatacagcccttccgcggtgagatcctcaatagcgttcgtcagcttctgccgcgtgtaagtttcttcattctttctgaacggcttcaaatagttttgatatgcctcttcattcggaaagctctgttccttttgcaaaagggtcgcgggttcttccgcattttccgatgtgatcggctgatcggctttggcatcccaaaactcgaatccttcaccggtttcgctgtagcggtatgtatgggtatacccgtggacaattacgcttccgcccatatcctgaagcttcctcagtactttgaccagcttcggcttttcagacatatagactttgtcgcctgtttcaggattgacatataccggaatcacagaaaggataaaaggaatattccgtttatgcagataagatccggcttggagcagcagtttttcatccgacatcgggctgatatcctcaagccgcaaatataacagcgtgctgccggccgtttcaccaaatgcctgtctgagctgtttagcggcgaggaggctgttgtttagcaaatcggttaacccgatgtacacgtttcctttgccggttttccatccaaaaggacgagcttttccttcgtcagctttgtatgtgtacaatgcttttcccttcaatcctgatacgtcgaggacacggactccgctttctaaagaggaatcgatttcctcatttgtgctgcgaatctgatacacattgtctttgcttttgagcgtaagacctgcaaattggctgaactgcccggcgttaaagccgatcgctatcacaggttttttggaggagctgatcagctgcgcgagctttttgctcagctttcttttcgtttgtccgtaatagatgacgcggtcttttgttgcgagatccgatgctttgacatccgcgtcttttatgacggccacacgggatgaaaaatggccggcgataaggtcgagaattttcacatcggctgactcttttccatccaatgttgaatagacgatgagaatgccgtgctcctgctgctttgcctcggcgctgtccggaacataaaaagccgcagacaggataagcacagccgcgtatagaagtaatagccgcttacagttcattcatcatcatctcgttttctagttcttctaaaaattgatcggcagtctttaaatcgttctgatatgataagtggcacacgtggaaggtcaaggtgacatacttgccgtttttcagctggtacgtatccagctgtttcttcagtttttcaaggacggcgggcatatgttcggcaggcgtgtgtgtcagcaggatgccgaaccgctcctcggcaggccggaactttttatcggtttcccggacacatgatctgatttgactgctgacaaattgaaagagacgatcggtttctttttctccgtacagggatttgaactctttgaaataatgcatatgaagcagtaaaaaaacaaacgagttgccataccgctccgcccgcttgatttcttctgacagctccagcttcatcctctgtttattatcaaagcctgtcaccctgtcaatcgcaacaaagcttttgatttcgtcttgaaggtgtttgacggagcggtgaagtccgatcgcgatgtcgtgtattctccctgacataaaggaaaacagcaacagcgccactccccagatgacgagcatttgcagtccggtttcagacgaagcagcttctccttggcctgtgtgaaaaaacatcatcaaagtgccgagaacaaacaggacgatgatggtcccagccagtgcgtaaatcgatccgagccatattcctgctgcgatgatggcaagtgtgatgcaaatgatgagaacgggttcgaaccgctggactgagatataatggatgaacaacgcaagcgctgctgcaagtcctgtcatataagcgaacattttatgcgattcattgaatgagattttcatttaaaagcttcctttcggctaataggggcagcagattatcaaaagaatgcgtatcatttccgctcatatatcccccataatacgtctcggacgaatcaagaatttcaaaatcattcattcgatcatacagcgctttaatgacggttttatcttcgttttggttgatgaagaataaaatcgccaacgcgtaaacggatggagactcgtattggaccgccggcttttttgtatcgagcgaataccggccatacagttttccgccggtttgaaacgtctgtttgagccaatccgctaatacagcggctttttgatccttcggaggtaaatgccaagctgcgtaaagctgatcaatgagattgacttcatggtcataggtgtatgctttcgtttctgtactgtatgcttttgggagaaaaccgtttttcaaaggggcgagataaagaatgctggcattccgactttcgagttctttatttatcactccattctttttcaagatggatagcgcatctggcatgatataggaaagcgtgatatcttttgccgcggattgagaggcggagtcgtaaaagtccgtcaatatcccgttgttcatgttgtattttcttaatgcggcaccgatgttccgagcggtttgtttatactcgctgtttccccatagagctgccgcttgatcgaggctcaccatgattctgagatcatcgatcagggcgttcaccccgcttgcctgaccgttttggatttgccatgacaccaggttgttgttcataaggaaggattcgttcaggtgctgatattgctcatggaaatgctcgccgtcttttttgctgatcaaaaactccatccacaagccaagcgattccgacaagtaaacaggctggtcggaaaagccggttttgatcagcccctgatcgctcattaaatgacggtaaacgaagtgttcggcaggctgaagcgcttcatcatttttctcatcatctgactgatcttcagctttgatacagccgacggccagactgacggataaaaagcacaggatcataccaatccatatatacctcacgggtgctttcacgatagatcaccccgaatgtttttttgagtaatgattttgacttatttattataaatgaaaaaatggagattgctagatttatttgatctttttggactatccaaaaacaggacgtaagtccaataataaaatgtttttccatcaatagcaggattttcgtattgatttttaaaaggggaaatgtagaagagaactagcgggtgtgctagcgcttggaaaaataaaataaacggagggcctgaatgtacatcatcagcaagcttgaaagacaaaatgtgaaagtgacagaaataccgaagtggggctcttacttgagaaaaacgtgggaaaaccgttttgccgcaagcatggagcttccggaaagggacgcgatcttggtgagccattttttgtggcatttattcagctatgggatgaagccgtgttttaccggcggacaggccgatcaagcctttagcgaacagccgaagcgcgattgctttttattctaccagcacacggatgacgcctatattcttgaacatgctgaacaactgatagccgcagatctgaaaggagaagaagatgcatatataacggataaacatatgacatggacatatgcggtgacgcatgagtctgcatacggaccgtattttgcaattcagctggatgagaaggagcatgaacctatataatatgggttaaagcgttactaaaggggaggaacgtgatggacaaggaaaaacagcaattgagcattgaagcagcgaggctctactatcagtctgactacagccagcagcaaatcgccgaacagctgcagatttcaagaccgacggtatcaaggctgctgcagttcgccaaggaaaaggggtatgtccaaatccgcgttatggacccgtttgaagatatggatgcgctcggtgcgatgcttgaggaaaaatacgggcttctagaagcgcatgttgtcttttcgccgaccgcggattatacgaccatcacgcattatctcagccgcttcggggccgaatatatgcacggcgcagtcaaggacggcgacattgtcggcgtcagctgggggacgacgatgtaccaaatcgcccaaaatatgcagcctaaacaggtgaagggcgcagaggtcgttcaactgaaaggcggaatcagccattccagcgtcaacacttattcgtctgaaacgattcagctgtttgccgaagcttttcaaacgatgccgaggtatttgccgcttccggtcgtgtttgacaatccggaagtcaaacagatggtggaacaggacaggcacatcaagcggatcatagaaatgggaaaacaggcaaacattgcgttatttacagtcggcacggtacgcgatgaagccttgctgttcaggctggggtattttcatgaagaggaaaaagccctcctgaaagaacgtggagtcggcgatatttgttcgcgcttttttgatgcggaaggaaacatttgcagcgatgctatcgattcgcggacgatcggcattgaattggctgacttgagggaaaaagaacggtcgattctcgtagcgggcggcagccggaaaaaagccgctattcatggtgcgctcaaaggcaagtatgccaatgtgctgattattgatcagcacacggcgaaagaactgcttgatgactgaagtgtccaggaagaacagcctggattttactttattttctattgaacaaaatttcatatgataatttacatttgttcaaaaatcggttatgctgaaactatcttatacaaaggaagtgctagtaaatgacgattgcaaatctcattgatcatacagcattgaaaccgcatacacaaaaatccgagattaagaaattaatagaagaagcgaaagcataccaattcgcttcagtctgcgtcaacccgacatgggtcgaatttgccgccgaagagctgaagggaacggaaatcgacgtttgcacggtcatcggttttccgctgggcgccaacacgacagagacaaaagcgtttgaaacaaaagacgctatcgcaaaaggcgcgacagaggtggacatggtcatcaacatcgccgctttaaaagacggaaacgatgactttgtcgaggccgacatccgcgcggtcgttgaagccgcaaaaggtaaagcgcttgttaaagtcatcattgaaacgtgtctgttgacagacgaagaaaaagagcgcgcctgccgcctggctgttgctgccggtgccgactttgtcaaaacctcaaccgggttctcaaccggcggagcgacagcggaagatatcgccctgatgcggaaaaccgtcggacctgacatcggtgtcaaagcatccggagggattcgtacaaaagaggacgttgaaaccatgatctcaaacggcgcgacccggatcggtgcaagcgcaggcgtttccatcgtcagcggagcagaaggaaaaaatgaagataactactaagatccagtgcggcgggaagcggaagcttcctgcgcgcagatacaaaaatgtaagcgaatacatcaccaggaggatcaaaacatgaaatatctcatcgggctcattggtttatttgtcgtcttagggcttgcatggctggtcagcagcggaaagaaaagagtgaaataccgcccggttatcgtcatgatcgtgctgcaattcgcattgggatatatattgctgaacacgggtgtcggaaactatctcgtcggcggttttgccaagggcttcggctatttgcttgaatatgcggcagaaggtgtgaattttgtctttggcggactggtgaatgtgaatgaatccacattcttcatcagcgtacttctaccgattgtttttatatctgctttaattggtattctgcaatattggagaatccttccgtttattataaaatatattggtcttgcgctcagcaaaatcaacgggatgggcaaactggagtcatacaatgccgtggcttcggcgatactggggcaatctgaagtattcatttcgttaaaaaagcagcttggcctgctgcctaaacacagactttatacgctgtgcgcttcggcgatgtcgaccgtctcgatgtctatcgtcggcgcctatatgacgatgctgaagcccgaatacgttgtcaccgcgctcgtattgaacttattcggcggatttattatcgcttcgattatcaatccttatgaagtcgatcgagaacatgatatggtagaggtacaggaagaggaaaaacaatccttctttgaaatgctgggcgaatatattatggacggctttaaagtcgccgtcgtcgtggccgccatgctgatcggatttgtcgcgatcatcgcaatgattaacggcattttcagcgccgcactaggtatatcattccaggaactgctcggatttatttttgcgccgtttgccttcctgatgggtattccatggcatgaagcggtgaatgctggaagtatcatggcaaccaaaatggtctcaaatgaatttgtcgcgatgcagtctctcgcacaaggcagcttccatttcagcggccgcaccgaagcgattgtttccgtcttcctcgtctcatttgccaatttctcatcgatcggtattatcgccggtgcggttaaaggactgaatgagaaacaaggaaacgtcgtcgcgcgcttcgggttgaaattgctgtacggcgcaacgctcgtcagtttcttgacagcgaccgttgtaggattgatctattgataaacattgaaaaaaggactggtgatcacaatgagaatggttgatatcatcacaaaaaaacaaaatggagaagaattgacaacagaagaaattcaatttttcattaaaggctacaccgacggcagcattcctgactatcaagcgagcgctctggcgatggccatctattttcaggacatgacggacagagagcgggccgatctcacgatggcgatggtcaactcaggcgaaacgatcgacctttccgcgattgaaggtatcaaggtcgacaaacactcaacaggaggcgtcggcgacacgacgacgctcgtacttgcaccgcttgtcgcggctctcgacgtacccgtcgccaaaatgtcgggacgcggcctcggacacacagggggaacaattgacaagctcgaagcgatcaaagggtttcacgtggaactttccaaagatgaattcatcgagctcgtcaaccgcgacaaggtcgccgttatcggccaaagcggaaacttgacgcctgctgacaaaaaactgtacgcccttcgcgatgtgacaggcacggtcaattcgatcccgctgattgccagctcgatcatgagcaagaaaatcgccgcaggggcggatgcgattgtccttgacgtcaaaacgggcgccggcgcatttatgaaaaccgatgaagatgcagtcaaccttgcaaaagcaatggtccgcatcggaaacaatgtcggccgccaaacgatggccgtcatctccgacatgtcccagccgctggggtttgccatcggaaatgcgcttgaagtgaaagaggcgattgatacattaaaaggcgaaggtcctgaagacttgactgagcttgtcttaacattgggcagccaaatggtcgttctcgccaaaaaagcggagacccttgacgaagcaagagagaaactgatcgacgtgatgaaaaacggaaaagcgctgcaaaaattcaaagacttcctgcagaatcaaggcggcgacagctctgtcgcggataacccagaaaagctgcctcaggctgcctataaaatcgacgttcctgccaaagaagcgggcgtcgtgtctgaaatcgtcgccgatcaaatcggcgttgcggccatgctgctgggcgccggccgcgcaacaaaagaagacaaaatcgacctcgccgtcggcatcatgctccgcaaaaaagtcggcgacgcagtcgaaaaaggcgaaccattggttaccctatacgcaaaccgcgaaaatgtcgatgacgtcatcgcaaaagtctacgacaacatccaaatcgcggaaacagccgaagcaccgaagcttgtgcatacggtgattacggaatagaggaacatgcaaaacagcacatacctttgggtgtgtgctgtttttttgatgtcacggaatttgagaaaaggtcatttgaactaagtccaggacgctattttaaataacatcgtttgtatcttgaattgatcgattcaagaaaatccaagaaaaccaagtccattatcctatttacctattttggatgatattgtaatatgaaaaaggtctgatttacaagaacgttagattctcccgtaaagcaacaatatacctaaccgaaatacagtggaataagcgaatagtaacgtgcggatttttattttctgaaaaatgaggtgaacccgatatgtctaaccatgctgctaaaatctcttctttggaaaaagatatttcttctttatctcacaatataaaggatacccaaagcaaaatcgctgaactgaaaaaagcaaaaacagctattaccggtgaacttcacaccctttcaaacaatgccactctcatcaatcagccagatattacatcacatatatggaatggcagacatacaaagcaatttatcaatattagatcaaacattgcacacagctatcaaaatatacagagagaaacagatggtctgatttcgcatattgagcaagagattgaaaatcttgaaatgcaaatttctaatatggagatgtttctaagtatacaaaaacaacagcttacagatataaaaaaacaagtcaatcattgaggtgaaagaatggcagaaataaaggtaaaagcagaagaagtcaaaacggcgttttcaagccttcagacaaaaatcagcgcactttcgatatcaggttcaaaagccgatatcgctaattcttcaatggatgtagtgaacaaaataaaaaaaatcgaaaaggaatacgagcagctactaaaaaaatacaaggaggcgctatcttcagttgaaaaggacgcatggtcaaacattaatgtcctgattgatactgataaaaacatctctcaaaaaatgaaataaggagggctggttttctcttgaaagttttagatgtttctgaagtcattgacgcgattgaccaattgattaaggaaaaaaagcaagaggaaaaagaaatcaacgccataagggaaagtgtacaaaaaattgcagagcttgatgatgcattaaaaggagaaggcggaaatgcgatcaaagaacacttttctgttcttcaccttcccgtgctgctttattttcagcactttatagatcaatacatacagaatttaaaagacattaaagcaaaaatcagaacttatgaatcaacagagggttttgtaaaagaagaatttctgacgcatgacgtcaaaaagggcttaacagaactgaaacgtcaaacgaatgatacggttgattcgattaatgacgaagttgataaaatcagccacttgattgggggcggatctatctctttggcatcatttaatgagcatatttccgaagccaaaaaacatgtgaacaacacggtgtctgatttaaaagagcttgatcgcgatgctaattctatattaaaacaatcgtcaaattcgatcgctcagctatccaagctcactgaaaaggtgaacacttggtcaaagggaggcgcgatcttatctaaaaaaacgattaaagaggttgaaaactacttttctgaaacagatgtcgttaaacaaatgattgacgaagccgttgatttagcagaaaaacaagacgatccgacaatgatgggcagaatcgctgaatggcttgatttaatcggaacaggaaacggcgcgttggccgtaacaaaaggcgtcatagccgtgaatgtactggcgacgaaaatgcttgagcttgaaaaagacggaaaaggaaacttccgtgtgaaagcctctccgaaatggacgcaaggagctaacggaaaatacgattccaaggtggctcagtttgtttacaacatcctgaaaaaaggcgatccaaactcaagcaaaccaataaaaaaatggctcggcaaatttcaaaataaaccaagcggccttttgagaaagattgttggattggggcctaacacaacaaggatctcctacaagaaaattttggagagccaaagtttcctaaagcataagccagaggaactgaagagttataagactaaggttgatgtgaaagggactgttgggaagtttaaggatgaagctagtattacaaaactcgccaaaaaaataccttatgctggaacaatattctccttgactacaaatggagctgagttttttagtgatgataataaagataaatcttggttcgaaaaatttggccgattttcagcagggattggaatggatgctggagttggagcgttgaccgctagcggagctggactgggttcattagtatgtccaggtcctggcacccttattggaggagcaattggagctggtattggtataactggatccataattgcgggagatcaagtaaaagaatggggagaagatgctgcaggttggatagaagataaaggtaaggaagctggtgaatggttaagtcaaaaggcctctgaaactacagatacaatttcagacggactctcaggtgcaaaggaatttgtcactagctggttcaggtaataaggaggagtataatgttagactctaaaattatattaacaacaaatgaactcgttgccgcatttttattgtgtaggtatgaaaaagctgctgaagatattatcaatgatcagcagttgattcaagatgaaaaagatattgagccattttcaattcaagccgaaaatcttttaaaacaaagaggatattgggctgatggcacagaatctaatttacaaaaagggttagaaaacctgattcacttactcattcaatcaaagcgaaaagttcgttgtatccatcggaaaagggtgctgattgtacaccatgttcaaaaagatgaactcattgtgcaggagatcgaaaatcaaaatcatagtttttcgattttaagaagcagagagtcgtttttagaaatgttgaaaacattttatcattcatatacagataaaaaaccagaacatgaaatttttgaaatggatgaagattcatttgatgagtttcacgaggttgaagctgacgttattaaaagaatggcggaagacccgaaaacgcatccgactataagtcaattttcctttgactttttagcaaacaaccaagagctcgataatatttcttttgtagaaagtgactatattcaaaatcaaacaagattagatcaagttgcttttttattaagaagtgataatttcatttggcatttagattatgaaaatattaaaaaaactggctcgctatatcttctaccagtggcagtcgacgaatattttgggaaaatagtggatacaatgaatgaattttatgatttatagtagaaaggatttctatttatgttctcttttaaaaaaagccgattcttttggctgagaagcaatgttattctaatattgttaactgctctattgttgttgaataaaccttattgggaaaaaaacgccaatgttatgttttttatgtttgtttgcattgctgagctgtttatcattttacttgcattggtatatggttttcaaacaaaaaagacaattgcgcgccctccttcaagagctataagaaagaccaatatcccaataggtatatttgttttttctatttttagtttattttttggatttgcgatgtcaggggatataccgtatcccaattctgcgcttatcatatatttaacaattaacatggtgtttgcatttgtttctttgtttgtaccaacattaatcattaagctatatgaagtcaacgtatatgacgaatcaaatgggctgatcaccgacttttttcgatatgtagccattctggtttcctctttaaattacgaagtccaaatcgttttagcccgcctcccttttgtattacagcgtctactgggcgtcattttcatcgctgttttgctgtgggagcttactatgatcggattaatttttgaaaacaattgatactgtagggtgtttcttagggttgcactgattgcagcctctttttcatgtctttttgaaatcagtcatgattcgcgtataatcacattcataacaccatcattcactggaaatcatatgaccaaaaggagtccatacatgagcaaagccagttttaaagaatatgcattaagcggcgatattacgaaagcgctcgatcatttagggtataagcacccgactgcggtgcagagcgaggtgattcccgcggcgcttaaaaagcgggatgttgttgtgaaatcgcggacggggagcgggaagacggccgcgttcggaattccgctttgcgagctgaccgaatgggaagagaacaaaccgcaagccttgattttgacaccgacgcgcgagcttgccgctcaggtaaaggaggatttgacgaacatcggccgctataaaagaataaaagcagcggctgtttacgggaagtcgtcctttgaacggcaaaaaacggagctcaagcaaaaatgccatatcgttgtcgggacgccgggccgcgtattggatcacattgaaaaaggaacctttccattagaaaaactgaaataccttgtcatcgatgaggccgataaaatgctgaatatgggatttatcgatcaagtgggagcgatcatccgccatttgcctgaagaacggctgacaatgctgttttctgcaacttttccggaggatgtggagcagctatcccttcaatatatgaaagaccctttaaaaatcgagatgaaagcaggcggtacgacaaccgcagacatcgagcatcaactgatcattgtagatgaaaatgatccattttcgcttttagtggatctgatcattgttgaaaacccggacagctgcatcgtcttttgccgcacacaggagcaagtgaatgagttgcagcggcgcctatccgttttgggttatccgtgcgagaaaattcacggcggcatgcctcaggaggatcgttttgccgtgatgaaccgtttcagacggggagcgttccgctatttaatcgcgacagatgtggcggcaagaggcatcgacattgagaacatcacacatgtcatcaactatgagctgccattagatcaagaaagctatgtgcatcgtaccggaagaacaggccgagccggcagccggggaaaagcgattactcttgccagtgcgcgtgaaaagaggatgattgctgacattgaagactatatcggttttcatattcctattattgaggagccgtcaaaagaagaaattgcacgggcaaaagcggcgtttcaaaagaaaatcaataggaagccggagcttaaacaggacaagagcgaatcgttaaataaggaaatcatgaggctctactttaacgggggaaaaaagaagaagcttagagctgttgatttcgtcggaacgattgctaaaattgacggcgtctccgccgaggatatcgggattatcacgatccaggagcaaggttcattcgttgaaattttaaacggcaaaggtccgctcgtcttagatgcgatgaaaaacacgacagtgaaagggaaattgctgaaagtgcataaagcgaggaaataatcttaggctgccgattttgtcgggagcttttttgctcgtaataaaccttggataagcagcatatgatggattgtcaaaaaatgaaagcgttttaaaagagaggagaacaaatgaatatgagaaagtgtttcatccaagtccttgcattgcttttcatcattgctgcatgtttcgcgccaaaccaagcctctgcacaaactcaaaaacctgttttttcagaagtgacggtacatgatccatcgattattaaagcgaatggcacgtactatgtcttcggctcccatttagcttcggccaaatcgacggacctgatgaattggacgcaaatttcctcgagtgtccacgacggcaatcctctgattccgaacgtctatgaagaattaaaagaaacctttgaatgggctgaatctgatacgttgtgggcgcctgatgtcacccagcttgaggacggcaagttttatatgtattacaacgcctgccgcggggattctccgagatccgccctcgggcttgctgtcgcagacgacattgaaggtccatacaaaaataaaggcatttttctgaagtcgggaatggatgggatcagcaatgacgggacgccttatgacgcgacaaagcacccaaatgtcgtcgatccccacacattctttgatcaaaacggaaagctgtggatggtgtacggctcctattccggcggaatttttattttagaaatggacaagaaaaccggatttccgcttccgggacagggatacggcaaaaagctgatcggcggcaaccacagccgtattgaaggcgcatatattctctaccatcctgaaacacagtattactacctgtacatgtccttcggggggcttgccgctgacggcgggtacaacattcgcgtcgcccgctccaaaaaccctgacggcccttattatgatgcagaaggccacgcgatgattgacgtccgcggcaaagaaggaacgctttttgacgatcgttcaatcgaacagtacggcgtcaaactgatgggaaatttctcatttaacaataaaaacggctatgtgtcgccgggccataactctgccttttacgatgaaaaaagcggtaaatcatatttaatcttccacacccgcttcccgggacggggcgaggagcacgaagtccgcgtccaccaattgctgatgaacaaacaaggctggccggttgtcgcccctcaccgctatgccggagagaagcttgaaaaggtgaaaaagtcagatgtgattggcgattacgaattggtgaggcacggcaaagacatctccgcagatattaaagaatcgaaagaaatccgcttgaatcaaaatggcaaaataacaggcgcagtagccggaacgtggaagaacacggggcataacaaaatagaactcaagatcgacggaaaaacctacgatggcgtgtttttgcgccagtgggatgcggcttctgagcgtaaggtgatgacgtttagtgcgttgtctcgtgagggagatgcggtttgggggagtagtttaaaaagagcggaattttaaaaggaatttcatctctaaaagcacattcctgattaaaggtatgtgctttttaaatgatttagatcaaatggttgttttaatatggaaattcaggatggattatacgataatacatatatggtcttttttactacataagttgttcgtgagattctatgaagaaaaatcaacaaggggtgttgataaaatgggttttaaaaggagttttaaaataatgcctggtgtcaaacttaatataaataaaaaaagtgttgggatgactttagggggcaaaaatggcaggataacttataatacttctggcaaagtaacaacaagtgcaaaaatccccggtacaggtctatcttatagttccagtaaatctatttcttcatcacaaaaacaaagtcacttgaataataacaattattcaaataatttagagcttaatgcttacctcaatcatttaacttcatttcatacgagattaacgagcaggcaaataaattgggaagaaattaaaaaagagtcaccgccagagattaatgtagctcaattaaaaagtgatttaaataattataaacccaatttctttgagagaattcttagattagataaaacaaaaattgaaaagttaaataaagaaattactgatgcagaaactaaatataagaaagaatatgatgagtgggtaaagcaacaaaaatttgtgaaaattattgatgacaaaaacagtgttgcttatagtgaaattttagaagatattattaagattgaagatactataggaaaaataaaagagattatttcgaatgaaaatagtgaagttttattgaatctattagtggacacatcaattttaccgaatcaagaagaatacatctcttctgctgggaacttgttaactaaaaagctaaccaaaacaaaatattatcaaaaccaattaaactttattgccagtctttctataggtttagcaaaagtaatctttcaaataattcctgttgagactgtatcgattaatgttttagaaaaaagaattgatacagtggatggacatgagaaaacaatgactatctttggcgttaaatttaaaaaagagcagttcatggctttaaatattaattacattaaaccaattgatactcttcaactctttgaaactagtttggattttaaaaagactaagggtctccaacctgtagaaggtatacacctttaattttgatacgaggtagatgaaatgagtcttattttattaatcattttattaattattattgcatgtatagtaaagtttggatctaactttgttcttgataaatttatatttccttctatcaaatacatgagtaaggagagctttaaaaagtttagaaagtttgttgaacaaaaaaataccttattaatttataaaaagacattgagagctagtgagtacttttttattttattaatgattatctttattgccgtaagtttattttgtgttttatcaccaagcaactctcttctcaattttttattttttggattactagctttctttcttttttgtactatctttataggggattttaatttaaatattaaaaaagaattagaaaaaaatcaaaaagaatacgagagtttaattgaaaatactatctctaaagtgaatagaaatagttatatttttgatagattaaaagtgttttttggaaaaacaggaatgagtctgtattttcattgtttatttttaattttaattttaacttttttaaccgaagttaacagtataccttatagtattttttatttatttttattgaccctacctctaacgttagcaagttggatttacttttcaactttcaatacggaagaacaaaatattagaaggattattgggtacctgttattgttgattataaccatttcaaaaagtttttccgattttaaaattgtaatagggttagaggttgctgattctgctaatgactatatcatgttcttaatccttacggtatttacagctatagatcgacttttaaaaagtatagttgatgattatactaaatttaaagaaaaaagaaaaattgttgaatgaatttatgtgccgggatgaaaaccccggcttttttctataacccctttcattttgacgaatcttttccaattcgttaacataaaaatagttcacgaagtgtaatatcaaacaaaaaggatgaagcgcaatgtgtacaagtatcacgttgacgactgcgggccgggagcatttattggcgaggacgatggattttgattttgagcttaacggggaggtgctgttgcatccgcgtcgctacaaatggaaaagtgaagcggacggcagcgagcatgccggccggtatgcgtttatcgggatgggcagaaggctcaagaatgctctgtttgccgatggtgtgaatgaaaaaggattgtcttgcgcggcgctttatttcccgggctatgctgtgtatgaaaacgaggcaaaagagcaaagccgcaatcttgcgccgcacgaattcgtgacatgggtgctgtcggaatgcggcgatttggaggatgtgaaaaaagcggctgtttccttaaacattgttgagagagaggtcagcttgctgagtacggtgacgccgctgcattggctattaacggaccgctccggggcaagcgtcgttgttgaaccgacggcagacggcattcaaattcatgataatccggtcggcgtgctgacgaacagtccggatttcccttggcatttgaccaatttgcgcaactttatcggtcttcagccgggacagtttgccgcgaaaaaaatgggaggcctgacgctgtcggcttttggtcaaggttccgggctgtccggattgccaggagattttacgccgccatcccgctttgtcagggctgcatttttgaaagagcacatgaagcctgtgtccgatgaaacagaaggcgtctctgccgcgtttcatgtcctctccaatatgaatattcctaaaggggttgttatgactgatcaaggcgaagacgattacacccaatatacggcggtaatgtgcagcgagacgtgcagctactattttcaccattatcaaagcaggcagattcaaaaggtttgcttattacaggaagacctggacagcaacgaattaaaggcgtttcagccaaagcaggaagagacggttcattctcttcaatcataaacgaaagaaggagcaacattgcaaaacaaagcagcagacagactcattttattaggcatcagtttacatagcatatattggttgttcattttatttttgttttttcatttcaaacatcagcttgacgcttatgctgtttggaatccaaatgtcacggacggatatatggaggctggaactttcgtagctgcgctgaaattgatgctctactcaggcacattatttaatttgggcctcttgttcattttgggcttgctgatagtgatattagcacagtcgatcatttttattgccttggaaatcgccgcttacgtaataatcaaaaaagatccgttttctccatggggatcttttattttagcgatgggcattaaaaacattttcacgaacttatcaagggattccgtttatggctgccggattcattcttcataagcagcaggaaccgaaagaagcagttgtagagccggcggcgcgaaggaaagcaaggcgaaaccctgcattgcttatgaaaaaggcggcgaaagctagaaaacgaagaaatgaaggtataaagtcttagtttttagttttcatgtattctattttttatgagacatttgtaatgaaagcgttgacatgaacaaaaacgggtgctaaagtatagttacaaactaatatcagcaagtttcttaaggattgttactgcttttgcaggcaaaacctaagttgcgtacagctttctggggcattgtcccgtttaagccggcgtaatttaggttttttttatacccaaaataaggaggtgatgtgagatttcgaggattctttcggcagcaggccaataaaaaaagccgggtgaaggcggccaccttcagtccggcagattcccccaaagaggaggtactcatatggattataataaagtatcgaaggacattttacaactcgtgggcggtgaagagaacgtacagagcgtgattcactgcatgacaagactgcgtttcaatctttatgacaatgcgaaggcagaccgcgcgaaactggaaagtcttccggctgtaatgggcaccaacatcagcggccagcagtttcaaatcatcattggaaatgatgtccctaaggtgtataaagcgatcattgccaacagcgggctcagcgatgaaaaagcgggcgagcagcaagctggcaaaaagaaaaacgtgctgtccgccatttttgatgtgatatcaggcgtatttacgccgattctcccggcgatcgccggagcgggtatgatcaaggggatcattgcaatcgccgtcacgttcggctggatgagcgaaactagccaggtccacaccattttatccgccatcggcgacggagcattttacttcctgccgattttgctggcggtcagtgtcgcgagaaaattcggcagtaatccttatgttgcggcggcgatcggagcggcgattctgcatcccgatctgacagcgcttctcggttcagggaaaagcatttcctttgtcggattgcctgtaaccgctgccacttattcgtcgaccgtcattccgatcctgctcgcgatttggattgcatcttacgttgagaaatggattgacaaagtcaccccgacttcgttgaagatgatttttgtaccgacgctgacgctgctggttgtcgtgcctgtcacattaattacggtcggtccgctcggtgcgattgcagggaactatctgtcaatcggtgtgaacggtttatttgaaaatgccggtttaatcacgatgatccttttagcaggaacgttctcgctgatcgtcatgacaggaatgcactatgctttcattccggttatgttcaacaacattacgcaaaacggctacgattacttgatacctgcgatgttcttggcgaatatggggcaggctggcgcgtcatttgccgtcttcctgcgatccagaaataagaaattcaaatcattgtcgctgacgacaagcatcacggctttgatggggattacagagccggcgatgtacggtgtcaacatgaggctgaaaaagccgtttgtatccgcgcttctcggcgccgctgtcggaggagcattttacggcatcaccggcgtagcagcatatattattggcggaaacgtcggtttgccgggaattacgacgtttatcggcccgacttttatacaggcaatgatcggtatcgtcatcgcgttctttgccgcaacggcgtttgcttttgtattggggtttgaagacattccttcagatgaagccgctgaacaaggagccgctccatctgaagcgggcgcgggagagatcattcaaagcccgctgaaaggcgaagtcaaagcattgagtgaagtggatgatgcgacattttctggagaagtcatgggaaaaggcgtcgccattgagcctgaagaaggcaaagtggtgtcgccggtatcaggcacgatcacaaccgtttttcaaacgaagcacgccctcggcattacaagcgacaatggggcggaaattattatccatatcggaatcgacacggtgaaattgaacggcgagcactttaccgtgcatgtcaataaaggcgacgctgtaaaaccgggagacgagcttgtctcatttgatatggatgcgattaaggatgcaggctatcagttgatcacgccggttatcatcacaaatacggaccggtaccagtcgatcaaacctttgaaatcagatgaaagcgttgacattgaggaagcgctgatcgcgctggcgtagaaagaggaaagcctgacaaatttggatgaggtgaaatgatatgactgaacaaacgaaaaagtttcctgaaggttttttatggggcggagcggttgccgcaaaccaagtggaaggcgcctataatgtcggcgggaaaggactctcgacagccgatgtgtcgccgaacggcgtcatgtatccattcgatgagtcgatggagtcattgaacctgtatcatgaaggcatcgatttttaccaccgctacaaagaagatatcgctcttttcgccgaaatgggatttaaagcattccggacatcgattgcctggacgcggatttttcctaacggcgttgaaactgaaccgaatgaagagggactcgaattttatgatcgcctctttgacgagctattaaaatacaatattgagccagtggtgacgatttcccactacgaaatgccgctcggtctgattaaaaaatacggcggctggaaaaaccggaaagtgatcgattgctatgagcattatgcgaaaacggttttcacccgctataaagaaaaagtaaaatactggatgacattcaatgaaatcaacatggttctgcatgcgccgtttacaggcggaggccttgtgtttgaagaaggcgaaaacaagttaaatgcgatgtaccaagcggcgcatcatctatttgtcgcaagcgctcttgccgttaaagcggggcacgacatcattccggacgctaaaatcggctgcatgatcgccgcaacgacgacatacccgatgacgccaaagccggaagacgtgctcgctgcgatggagaatgagagaagaacgctgtttttctcggatgtacaggcgcgcggggcttatccgggctatatgaagcgcttctttaaggaaaacggaattacgattgaaatggctgaaggtgatgaagacatcttaaaggaaaacaccgtcgactatatcggtttcagctactacatgtcaatggtcgcaagcacgagtccggaagacttggcaaaaacggaaggcaacctgctcggcggcgtcaaaaatccgtaccttgaatcgtccgaatggggctggcagatcgatcctaaagggatccgcattacgctgaatacattgtacgaccgctatcaaaagccgcttttcattgttgaaaacgggctcggcgccgtcgatgtcgtcgaagaagacggctccatccaggatgactacagaatcaactatttacgcgatcatttaaaagaagtaagagaagccattgcagacggcgtcgacttaatcggctacacatcatggggcccgatcgacctggtcagcgcatccaccgccgaaatgaaaaagcgctacggctatatttacgtcgatcgtgacaatgaaggaaaaggcacgctttcaagaacgagaaagaaaagcttttactggtataagaaagtaatcgaaacgaatggcgagagtttgtgatatacagaatggctgtcctttacaggacggcccttttttttctctgtagcgcgtgaaaacaatttgctatacacttgatttagaaaatagaaaaaagcgcggtgaggcaaatgtttaaactgctgttgatagaagatgatgaatcgctgtttcaagaaataaaagagcggttaaccgggtggtcatacgaggtatacggcatcaacgatttcagcgaagtgatgcaggagtttgcggcgattaagccagactgcgtcatcatcgatattcagctgcctaaatatgacgggtttcattggtgccggcagatccgctcccgttccaacgttccgattctctttttatcttcgcgcgatcatactgctgatatggtcatgtccatgcagttcggagcggatgattatattcagaagccgtttcattttgacgtgctgattgccaagatccaggcgattttccgtcgcgtctacgactataatacagagcctgagattcttaaaaaaacgtggtgcggtgcaaccgttgatcccgaacaaaaccgcgtcagcaataaggcgggggcgatcgaactgacaaggaatgaaatgttcattttaaaacaattgatcgaccaaaaaaacaaaattgtcagcagggaagaattgatgagaagcctatggaacgatgaacgctttgtcagcgataacacgctgacagtcaacgtaaaccgcttaagaaaaaaactcgatgccttgaacttggggcaatatatcgagacgaaggtcggccagggctatatggcgaaagaagaaggatgatgagaatgctgaaagcgtttttgaccgagaggcgaagctggatcgccatatttgttttgcagcagatcctctttctgtttatcgcttatgtcgatgcatccattccttttacgtcgattttgtatatgacctatttgtcctcgtttatttttatcgtttttgtaattgtccgctttcggaaggaaacgaagttttataaaagtcttgaagaatgggaccacaatctcgatgtgacaaacattcgagaggcggaaaccccttttgaaacgatgattgaaaaaagcatagccgaacaaacgaaacagttaaagcaagaggcggcacagcatcgcctggcattggagaatgaaaaagatgagctcatggcctggatacatgaagtcaaaacgccgcttaccgccatgcatttgatcatggagacgattgaggatcaatctttaaaagcgaggcttgcgtacgaatggctgcgcatccacctgctgctcgaccgccagctccatcaaaagcggatgtcatttatcgaaaatgacttgtcccttgaagtcctagagcttaaacctatgatctttaaagaaataaaagatttgcaatcatggtgcattccaaaagggatcgggtttgatatacagctggaggcgggggaagtgctcagcgatgcgaagtggctgtcttttatcattaggcagctgctgacaaacgcggtgaaatacagcgaagcatccgatgttttgattaaaagctatgagcaggatggcaaagtgcatctcgctgttcaagactttggacggggcatcgatccaaaagatatgccgcgcgtgtttgacaaaggctttacatcaacaacggagcatcatgatcaggccgccacgggaatggggctgtacttggcaaaaaaagcggcaaagccgctcctgattcatatcgaggttgattctaaaccgggaacgggtacaacctttacgctgatttttccaatgcggaatgaattttcccgtgtgctgggcgtgtgacaaaaatgtcacacgcttttcttttttgttcgcttaatcgaaggaaaacggctgccttcctttctataataaaaatatccagtaaaaaggagattttaaaatgatgattttagaagcgaaaaaaatacgaaaaagctatggaaataagcacaataaacacgaagtgttaaagggaatcgaccttcagattcaaaagggggaatttgtcagtattatgggcccgtctggttcaggcaaaacaacattgctcaatgttctgtcctctattgaccaggtgagcggcggaacgattaacatcaaccaagctgagatgacgaatatgaaggaaaaacagcttgccgagttcaggaagcagcatttaggatttatcttccaagaatacaatttgctcgatacgctgacagtgaaagaaaatatccttctgccgctgtcgattacgaaaatatcaaaaaaagaagccggtcaaaagtttgaggaagtcgcgaaagaattaggcatcttcgagctgaaggataaatatccgaatgaaatttccggggggcaaaaacagcgcacatcagcagccagggcgtttattcatgagccgagcattattttcgctgacgaaccgaccggtgcgcttgattcgaaatccgcatcagacttgttaaacaagctgagccaattaaatcaaaagcgccgggccacaatcgttatggttacccatgatcccgtcgccgcgagcttctgcagtagagtggttttcattaaagacggacaaatttatacgcagctgaataaaggcggacaggacaggcagatgttcttccaggacatcatgaagacgcaaggcgtgttaggcggggttcagcatgagcattaatcagctgatcatccgcaacctgaaaaaaaatatacggaactattacctttatgtgtttgcgttgatcttcagcgcagcgctttattttgcgtttgttacgctccagtatgatccagcgatcaatgaagtgaaggcatcgataaaaggcgcagcggctttgaaggcagcttccattctccttgtggcagtagtagcggtgtttgttttgtatgccaatacgatatttatcaaaagacgaagcaaagaaatcggtttattccaattaatcggcatgaggaagcaaaaaatcttccgcatcttaagcttggaaaatgtcatgctgtatttcggctctttggtcattggggtgtttgccgggttttcgatctcaaagctcgtgctcatgattttgtttaaaattgtagatgttcaagccgaagccaaattgaatttttccgtcgaagcgcttgtgcaaaccgtcattgtattctgcggcatctaccttctcgtaatggtgatgaattatgcgtttatcaaaaagcagagcattttatctttatttaaagtgacatcagctacggaggataaggtaaagagaatatccgttttccaaatgatcatcggcttattgggcatcttgtttattttatccggatactatgtatccactgagcttttcagcggaaaattcaagaccgtagatgagctgttttatgcgatgagctttattctcggaaccgtcatcatcggaacgtacctcttctataaaggatcggtcagctttgtctccaacatcatccgcaaaagcaaaggaggctacttgaatatttatgaagtgctgtccctttcatcgatcatgttccggatgaaatcaaacgccctattattaacaatcattaccaccgtttcggcgctggcgatcggattgttatccttgagctatatttcgtactattctgcagagaaaaccgccgaacaaaacgtggcggctgatttcgccatgacaaatcaaaaggatgcaaagcgttttgaacaacttttggacgaaaataacatttcctacagcaaaaaagaaattcatgtcattcaagcggtttttaatctggaacaaattgtcgatggagatcctgaaaatatggctggagacccggggaaattgcccctcgccgtggtcagcgatgcagagattgccgggatggacgtgccaaaaggagacgtcattttttcaggatataccgaccttctccagaaatttatggctttaaaagagaccggtgccgttaaggtaaagagcaggcatgagacaatcccattaaactatttaggcttgaaaaaagagtctcttttatccttcaactttaccagcggcggattgcctgttgccgttgtagatgatgcgctgtttaaacgtcttagccaagacaaagatccaaagctgcagcagaagccgagccttttttacggaatcaatttaaaacatgaagatcagcttcagcaggcaaatgagctgtttgcaacagtgaatcaaaacgatcagcatttatcgctccttgatgcaagcacagctcaaaaatcgcttttcggccttgccatgtttattgtaggctttttaggactaacgtttctgatcacttcaggatgcatcctatattttaaacaaatggacgaaagcgaagatgagaaaccgaattacacgattttgagaaaactcggtttcacacggaacgatctgttgaaggggatacgaatcaaacaaatctacaacttcggcattccattagttatcggcctgtctcacagctacttcgccgtccagtccggctggttcctattcggggcagagctgtggacgccgatgatcatcgtgatggtgctgtacaccgtcctgtactctattttcggcttgctttccgttctttacggcaagaaagtgatcaagtcggcgctgtagctgagtcatgtggaatctcgcgtcgcttgaaggaaaacgatgaccctatatggagaaaaactcctttaccatattgaacatcatccgccggttattttcagaaaagcataatcaaaagcccatcggactcatccgatgggcttcctcattttctacagctcaaccttgtagagcgtttgccgctgtccgccgcctgggccgcctcttgcaccctgctgtgcgaagctgtctgtactgctgtattggtcagacgaaatttcggttccgttttctttgatccaggagacgagctcgctgttgcctgagttttcactaatcaggaagtattttactcttccttttttgatgaggtttttcagttcactgaccgacaggatcgggtctgtgccgttgaagcctccgagcgccatgacattttcgtcggcattgatgatatacgtggctgcggttaccgttgtcaatgtcgcgaaaaggtactcttcgccggtattattttcccggaggtatgtgagcagtcctgtgtccacgtccgagctgaacattccgcctccgttggagctttgcagctgaggccctgattcaggaagaacgctgttccctccgtaaaggatcggtgttgccgaccaatagaccggtgtcaaaagaagcacgcacaagctgatgatggtgagctgctttccgaatggatggcgtcgcttcagcatcagtaaggcgatggtgacacccagccccaggattcccatgacatacatccaagcgctgccgatttggtttgtataagcgcttaaaatgtacacttggaatgctgctgtcgtgagaacggctgccggcagcagatagcttgcccagtctttatgattgttgtaaaggccgtacatcgcgtaccatccgattcctgacagagcggcgatcggcggcgccatcataatcaagtagtagtggtggaagaatccggcgatgctgaagaacccggcgacaggaacgagccatgcagaccaaaagatcgtttctttcatttcgcctgctttttcgcggcggccgcgaaaccacgtgatgatcgtgccgagcagtcctaataatgcaaatgggagcatccagctgatttggcccgataaagccgattggaagagcctcagcggtcctgcgtcaccggtgccgaacatgttcatgctttgtccgccgccttgacctccgcctgggccgccattgcctccgggaccgccgttgcctccgcccggtccgcctccgcccggtccgcctccggctggctgctggctgccgccgtttgccccttgagaactgccgtctgccgaaccgcccgcacccggcggctgcatcgcgccgttttgtccattggagccgccggacgaacggtttccgttctgagcttgcgcattgccgttcggctgctgcatgtctcctccaaagccgttcatatcgccgcgggcgttgcccgtcgtctggccgagaagccgctcagtgccgttgtagccgaaagccagttcaagcacagagttggtttggctgcttccgacatacgggcggctgtcggctgatgtatagtcgaccgcaagcgcccaagaaagcgaaatgccggtgaggacaataagcgataaaaccgctgaaacgatttttttcttccaattcgcatgggccgcaatgagataaaacagcaagaacgcgggaagcaccatgaatgcctgaaacatcttcatattgaatccgaggccgatgagaccgaatgcagcgagaagccagatcagcctgccttgtttgaccgccttcatcaggcaccatgtaccaagtaggagcgtgaagacgagcatgctgtcgatattattcgttcggcttacggcgaccgcgatcggcgtcagcgccatcaccagcgctgaaatgcgggcggcgccttttccgaatttcggctttatcagtgcgtaaagcagatagatggaacccgcccctgcaagcgcctgcggcaaaatcacactccacgtatgcacgccgaagattttcgcaaatatagtctgaatccataaaacgacaggcggtttatctactgatacgaatccggaagagtcgaatgacgcgaagaagaaattgtggaagctttgcgtcatgcttttgactgctgccaagtaatactggttggcggcatcgtccagccaaatgttatatgtattcagaataagagctgccaacaaaattagaaccagaatgacatcaagttgtttgttttttattttcatcatcactttcacctctttatgttccctattctagaagaaaaatatgaacaagctatgaataaaaagagaacaatctatttttgtttgaatggaaaaaaataaatattttttggaaaaaggtgtgtacattttcatttttgcgctgtatactgtactacaacagaaatataaaacataaaactgttctataaaaaggaggttatacaaatgagcttgaaaagtccgatggaatttttcagaacgcttccgaaaaaaacgtgccctgaatgcggcgaaaagatggaggagcaggctgaatcttacttcatggaatgcgagcgctgtcttgccaaaaaaggcgagtaggcaaactgttttataacaaagcatgtaaaggggtagggagacatgaaaacagaggagaagagaattcatataaccggatcgataaatccgcattatgaagagattttgacaaaagaagcgatggagtttatcggacgtcttgaacgccatttcgggggaagaagacgggaattgctgcatttgcggacgatcaggcaggctgaaattgatcaagggaagaacccttgttttttggcggaaacgaagcacatccgcgaggcggactggacagtcgcgccgctcccccgggatttggaggaccgcagggttgaaatcactggcccggtcgacagaaaaatggtcatcaacgctttaaattcaggagcgaaagtctttatggccgactttgaagatgcgaactcgccgacgtggaaaaactgcattgaaggccaggttaatttgcgggatgcggtccgcgggacgatttcttttacgaatgaacagggcaaacgctatgagctgaaagagaaccccgccgttatcatggtcaggccgaggggatggcacttggaagaaaagcatgtgctgatcggcggcaggcccgtgtcagcaagcctgttcgattttggtctttattttttccataacgcaaaagagctgatcaaaaaaggaagcggcccttatttctaccttccaaaaatcgaaaaccacctggaagcaaggctgtggaacgacgtatttgtttatgcgcaaaacgacttgcgcattccgcagggcacgattaaagcgacggttctcgttgaaacgatcctggcggcctttgaaatggatgaaatcctctacgaattgaaggaacattcagccgggcttaactgcggcaggtgggattatattttcagctttattaagaaattcaggaacagggatgaagtcattcttccagatcgctcagccgtgacgatgacagttcccaacatgagagcctactccctcttggcgattcaaacgtgtcataaacgcaacgtccatgcgattgggggaatggcggcgcaaattcccgctaaagacaaacctgagatcaatgaagccgcatttgccaaaatccgcgaagataaggaacgtgaagtaaaagacggccatgacggaacatggatcgcgcatcccggcatgattcaaacggcgctcgatgtattcaatcagcatatgccgtcggcgaaccagattcatagaaagcggaaagacgtaaaggtcgaggaaaaagacttgctggaagtaccgaaaggcagaattacagaagcaggcgtccgtaccaatatcagcgccggcatccgctatttagcttcatggctgtcgggcagaggcgccgctccgatcgaccacttaatggaggacgctgcaacggcggagatttccagagcccagctgtggcaatggattcgccatccgaaaggagttcttgacgatggccggaaagtcaccgcggaaatggtcaagatgatgaaagagaaagaaatgcagaaaatcatcgatgaagcaggcgtggaacattttcggagcggccggtttgaagaggccggacagttatttgaacagctgattttggatgatgaattcgcggagtttctaacgataccggcttatgaaaatatataatgggggaatgtgcgatgctgaaagaaaaacaactcgcagaaagctgggagcatgatgaacgctggaaagggatcacaaggccgtatgaggcggcagacgtcattcggctgaggggcacgctcgagattgaatacacgattgcaaggcgcggcgccgaaaagctgtggaagcttctccatacagaggatttcgtcccggcgctgggcgctttgaccggaaaccaagccatgcagcaagtaaaggccggattgaaagcgatttatttaagcggctggcaggtggctgccgatgcaaatatgtcagggagcatgtatcctgaccaaagcctttatccggcaaacagcgtcccggaagtcgtcaaaaaaatcaaccgcacgctgcagcgcgccgatcaaatccaccatatggaaggaaaggaagacatcgattggtttgctccgattgtggccgacgctgaagcgggcttcggcgggcagctgaatgtgttcgagctgatgaaaagtatgattgaagccggcgccgcgggagttcactttgaagaccagctgtcgtctgagaaaaagtgcgggcatttgggcggaaaagtgctgcttccgacgcaaacggcggtacgtaatttgattgccgcgcgcctcgccgcagacgtgatgggagtcccgaccattcttattgcccgcacggacgcgaatgcggcagacctgatcacaagcgacgtcgattcatatgatgcaccgtttttgacgggagagcgaacagcggaagggttcttcaaaacaaagcctggccttgatcaggcgattgccagaggtttggcgtatgcgccgtatgccgatttgatctggtgtgaaacgtctgagccgaatattgaagaagcccgccggtttgcacaggcgatccatgaaaaattcccgggcaaactgctcgcctacaactgctccccttcgttcaactggaaggccaaactggatgacaacaccatcttgaactttcagaaacagctcagtgaaatgggctataaatttcaatttgtgacattggcgggcttccacgccttaaatcacggcatgtttgaattggcccgccaatataagcaccgcggaatggcggcgtactctgatctgcagcaggccgagtttgccagcgaagtccacggctatacggcgacaaggcatcagcgcgaagtcggaacgagctactttgatgaagtcgcccaggttgtgacaggcgggacttcatcaaccactgcactgaagggatcgactgaagcggaacagtttcaatcataaaaacgtgaaaaagccgcccgtcattgggcggcttgcttgttgtctatcaagttagcaattgacatcattggaaggggcggtaaaagagttttccctaataacagtcagtgtctgatgattcctgttgtttgttttggccggccggttgtctttgctgaaagaatagaacaaatacacggccattgtcaaaatcaagataaacatcatcataaatatcccctccaaattttttgtcttcactatataagacgaacaagcccggaaaaggtttcagaaaatttatatttttctataaatatttccgattgccgactttctgtatgaaacccggcggttctatacaagaataaaactgaaaaactcaggttgacatcataaccattgatgtgtagagtaaaagttaatgtaataggaagtccactaggggagccgtaagccggctgagacaagaagcgatcttggaccctttgaacctgatctagttcatactagcgtagggaagtggagccggtgtcttaatgatttcatcatactaaggccgctccattttggggcggcttttttgcgtataaagccgcttgcccccctgtgccttcctataaaaccgattgctaaggaggctatctacatgagtttttccgcagaacttcgccgcgaggcagaccctatttttgaagccatttttgagcatccgtttgtactggggctggcgtccgggaggctggaaaaggagcagcttgttcattatgtaaagcaagattacgagtatttgaatgcctttattcaaatctacggaattgcgatttccaagtgtcaaaatcgaaaagatatggaaatgtttcatgagcagatttcatttgtgctagacagcgaagtgcacccgcacaaaaacctgtgccgggccgctggggtggagtacgaaactctgcagggctatccgcttgcgccttccgcccatcattatgtccgccatatgctgacggcggcgcacgaaggtacgctgggagagatattagccgtcttgctgccttgtccatggacatattgggagatcggaaaaaaactgatgaaggacgttcagcctgatccatcgcatccattttatgactggatctgtttttacggaaacagaacggattcaatcacgacaaagttttgcgcccgcctggatgaatgggccgaaacagcgggcaaggctgaaaaagaaaaaatgaaggagctctttttgcaaagctgtcagcttgaatacggcttttgggagatggcttatacggttgaagattggcctgtggaaatgggggcggtgagacgatgaattggaacatgaaagaagtcgtcatgacagtcatcttgtctgtggcatgcggcgtcatttatttagggtggtctaccttgtggatccctgtttcagctatcgtcgggcccgtcggagcgaactttatgttcggcatatgggtgatcgccagcccgattgtcgcttatatcatccgtaaaccgggtgcggcgctgattgccgagacggcagctgcggcggtcgaactgctgaccggaagccattttgggctttcagcattattaatcggtgtgttccagggagccggtgcggaaatcgcgtttgcgatctttcgctataagcgctataacttgtttacccttatgctttccggtgcgctagccgcggtggggagcgcgacatacagcctgatggcaaacggttttgcctactatacgacgcaaacgctgatattgacgcttatcatccaaatcatcagcggcattgtactcggcggctggctggcaaaagccgttgtcgaagcgcttgcgaaaacgggagtcctgaaccagtatgagatcatgaaagaacaccggaagaaggatgatgccgatgcgttcatttctcggatgcagtaacctttccgtccgtttttatcatcgtcctgaaacagtcttggaccgggtctcgctgtcgattgagcagggagaaaaagtgctgatactcgggccgagcggaagcggaaaatcgacgctgttgtccgtgctttccggcatcattcctgaacatatcgaagctgaagtcacaggcgaggtcaaccgcagaaagagcgccggcgttatgtttcaggatccggattcgcagttttgcatgcttcatgttgatgaggaaatcgcgtttagccttgaaaatcgatccgttccgccaaaagatatggaccgcatcatctcggagctgatggagctggtcggtttaaagatagataagaaaacgccgatcgaaaccttgtcaggcggtatgaagcagaggctggcattagcgtgcctgctcgctttggagcctgaagtgctgttttttgatgagccgacggcgcagctggacccggccagccggcaagacatctttgccttgctccgcgacgtttcccgaaaaagcggacagacgatggtgttcgtcgaacacgtgctggacggctgtatcgagtggatggaccgagtcatccttttcaatgaaaagggacagatcatcgctgatggaaagccggaagaaatcgtcaaacattttcagccggaaatgaaagcggcaggcatctggcagcccaaactgtaccccgcagtatgggaagatgttaccacacaagatgatcatccgctcgccgtcaagctctcttctacattgaaaatgaaagaggaggaagcgaaaaacaggccgtcagcagacagggacatattgatccgcacagaggacgcggcgatcggctatcggaaaaagatcgttgccgacggcatcaacctggagattccaagaggggaatggatttccgtcatcggcgggaacggcagcggaaagagtacgtttttaaaaagtctgatcaggcttgaagcggtcaaaaaagggcgcatttatctggagggccgggagctgaagaaatggtccgatcgtacgctttacgagaaggccggctttgtctttcaaaaccccgagcttcaatttattcgggacacggtgtttgacgagatcgcgttcggagcgagacagcggagctggccggaggagcaggtcgaaaggaaaacggctgaattgctgcaggaattcggacttgatggtcatcaaaaagcgcatccctttacattaagccttgggcagaaacggcgtttaagcgttgcgacgatgcttttgtttgaccaggatttgctgctgcttgacgagccgacattcggtcaggacgaaaagacggcaaaagaattgatcaagcgcttaaaggagcggcaggaacggggaacgacgattgtgatggtgacgcatgacatggacatcgtagacgagcactccgaccgggtcatcgtatttcatcaagggaaagcggcatatcaaggaacgccgtatcaattgttctctgaccaagacctggtccgccgcttttcattgataccgccgcttcactaccggttcatgcacgaaagaaaggagagggttcccgtatgaaaagcaatggttcacttctttcggcattgaacccgagcgccaagctcttttcccacctcctggtcatgtgcattctcatgtttgtttcaaatccgaaaccgacttttttcatttggctgtttgcggttgtcatcgggatttttttcgggggatggactttgtcttatttaagtaaacggctgctgccttatcttattttttttattctcgtattttggatgatggccgcttttgggaaaggcgaggaaacgatttgggaatgggcctggttccgcgttaccgaggaaagcgtcggcaatgggctgacaatcgcgctgcggatgctcggctttgtcacatacggtctcttgtttacgtcaacaaccgatttgacgcagtttattatgagcctgattcatcaatgcagattgtcgcctaaatgggcttatggcttgctggccggcttccgttttgtcccgctttttcagtcggagctttcgcaaatgaaggcggcgcacaaaatcaggggctataagcaaaaaaacagctggaaggcgtttattcgctatgcgctgccgttgttttcgcaaggcatccgcaaatcggaaagaatcgccgttgccatggaagcgagagggtttaccggtacaaaagaccgcacctactatcaaacagcggggctttccggaaaagacttcgtatattttgcgggtctggcatcagtcgcagcggggattttgctcactttttaagaaggttttttacagggccgccttgcggctctttttttataaacccgggtacaggcgggcattctgtaaaatgcaaacatttcggacgttgactgaaatatattgacctaggccaaaaaggttgtacaatcaatgtgtaccatttgaaaaaagaagtataaaaaaatccccttaaaagatgggagtggcgcgatgtgaaaattgccaaagtgatcaacaacaatgtgatcagtgttttaaatgaacagggtcaggaattagtggtcatgggcaggggaatcgcttttcaaaaaaagcctggcgaagcggtggatgaatcgagaatcgagaagattttcaggcttgataataaagatgtatcagaaaggtttaagacgctgttggacgaaattccaattgaatttatggaaatgtctgaagaaattatctcctatgcgaaattaaagctcggcaaaaagctgaatgacagcatttatgtctcgctgaccgaccatattcatttcgccgtcgaacggcataaaaagggactggatattaaaaatgccctgctttgggagacgaaacggctgtataaagatgagttcgccatcggcaaagaggcgctggccatcattgaaaagaagacggggacagctcttccggaggatgaagccgcctttatcgcgctccatatcgtaaacgccgagctgaatgaagaaatgccgaacatcgtcaatattacgaaagtcatgcaggagattttaagcatcgtcaagtatcactttcatatcgaatttgacgaagaatcgcttcactattaccgcttcattacccatttgaaatttttcgcccagcggctgttcagcggaacctatatggaaagccgggacgactttttatttgaaaccgtcaaaaataagtaccgggacgcttatgtttgtacaaataaaatcaggcagtatatcgaaaaagaatacggtcatcagctgacaaacgaagagcttctgtatttgacgattcatatcgagcgagtcgttcatcaaaaatagaggatgatatcaaatgaaagcgttgacaattggataaatgtatgctactttttacttacatcaacttatacaggttgttaggattgttactgatgatgcaggcaaaacctaaatgactgtgaagcgggactcttatgcccttgtttttcatagtgatttaggtttttttattttcatattgtcttaagcgggattgttactgttcggcaggcaaaacctaaactaagccttctttgtacaggctttagtttaggttttttattttttaacagcttgatagggctttacgagagacaggagatgatcaacgatgaatgttcaatcaatggcaaaagaaattctggcgcgcgtcggcggggagaagaacgttgtatcgctagtccattgcgcgacaaggctccgcttcaaactgaaagaccgttccaaagcagacagagaagcgcttgaaaatacggatggcgtggtaaccgtggtggagagcggcgggcaatttcaagtcgttatcggcaataacgttcctgaagtatataaagaaatcggccggatctctcaactgttggaaagttctgcggccgatcacagtcaaaaagagaaaggaagcctcgccggtagattagtagatgtcgtatccagcattttcactccgctgctcggcgtcatggcgggagcggggattttaaaaggcctgcttttgatttgcacaaacgccggctggctctcgccggaagagacgacatatacgattctatacgcggcagccgacagcctgttttatttcctgcctttgctgctcgccgttacggccgccaaaaaattcggagcgaacccgttcatagcgctgacgattgccggagcgctgatctatccgacgatactcgaactgaaaaacagcggcgcccatacggagtttttcggcattccggtcgtcttgatgaattatacgtcgaccgttatcccgattatccttgcggtatttgtgatgagctatcttgaaagattatgtatgcgctttattcatgaaagcgtgaagaactttatcacccctttattatgcctgacggtgatggtgccgttaactttgatcgtattcggaccgctcggcgtttacacaggaaacgggatcgcggcagcgattctgtccgtttttgatttcagcccgattctggcaggagcgattattgcggccttatggcaaatccttgtcatcttcgggattcactgggggatcgtccctgtcattttgaacaacattgccgtccacggcaaggactacattaagccggcgacggcagccgccgtgtttgcccaaacaggagccgcatttggcgtcatgctgaagacgaaaaacaagaagctgaaagcattggcaggatcagctgccgttaccgggatattcgggattacagagccggccgtctacggggtgacgctcaggctgaaaaagccgtttgtatgcggtgtcatcagcgcggcggcaggcggagccattatcggatactccggcagcgtcgccctcgcttccggcgctccgggcttgttgacgattccgattttttacggaccgggctttctcggcttcatcatcggcatttcagtttcatttgttttatcgattttgctcacttacattgtcggctttgacgaccctgtggaggtgacaaaagaggagcctgttgaaaaaagcgccggtttacagccctttgcaaggagaagtcctgccgttaacagaagtatcagataaagtgttcgcatcgggggcgcttggagagggaatcgcggtggttccgtcaaaaggcgttgtcaccgcccctgcggacggcatcgtgacaacggcatttccgacgggtcacgcatacggcataacgtcggaaagcggagccgagattttgattcatattggaatggacacagtcaggctcgaaggaaagcacttcaatcctaaagccgtgcaggggcaaaatgtgaaacggggtgatatactcgcagaattcgatctggacgctttgaaagaagaagggtttgacgtgaaaacgccgatcatcgttacaaattccggtcaatacacggatgtcattccaacggatcaaaaaaaggtgaaaactgaagaacggatcatcactttaatttcatcaccaagggaggaaaataatcatgaaatataaaacattagctcaatttccgaaagattttttgtggggcgcgtctacttccgcttatcaagtggaaggcgcttgggacgaagatggaaaagggccttctgtcatcgatgcgcgcgaaagctacccggaagggacaaccgattttaaagtcgcaagcgaccattaccaccgctataaagaagatatcgctttatttgcggaaatgggcttcaaagcgtaccgtttttcgattgcctggacgcgcatcattccggacggggacggtgatattaatccgaagggaatcgaattttacagccgtttgatcgatgaacttctaaagtatggaatcgaaccgattgttacgatgtaccactttgatctgccgaatgctttgcagaaaaaaggcggctggtcggacagggccacgattgatgcttttgaaaagtatgcgaaggtcctttttgaaagctacggtgaccgcgtcaaatactggctgaccatcaatgagcaaaatatgatgatcctccacggatctgcactcggtacactcgatccgaacttggaaaatccgaaaaaagagctttatcagcaaaaccatcacatgctcgtcgcacaggcgaaagcgatcaagctttgccatgagatgctgccggaagcaaaaatcggtcctgcgccgaatattgcgctcatctatcccgcttcttcgaaaccggaggacgtgctggcggcttttaactataatgcgatccgaaactggctttacttggatatggccgtattcggacggtacaatacaacagcgtgggcatatatgaaagaaaatggctgcacaccggtcatcgctgaaggggatatggacattctgcggtcggccaagccggattttatcgcgtttaactactatacatcgcaaacggctgaagcaagcaggggtgatggcagcgacacggctgctcgaggcggagaccagcatttgcagacgggagaagaaggcgtatataggggaagcagcaatccgcacctaaagaaaaacgcatttggctgggagatcgaccctgtcggtttccgttcgacgctgcgcggaatttacgaccgctaccagctgccgctgatcgtcactgagaacggcctcggcgcgtttgatcagcttgaagacggagatgtcgtaaatgacgattaccgcatcgattatttaaaagagcatatcaagcaaattcagctggcaatcacggatggagtcgatgttttcggctactccccatggtctgccatcgacttaatttcgacccatcaaggctgttcaaaacgctacggatttatttatgtgaaccgcgatgaatttgatttgaaagacttgcgccgcattcgcaaaaaaagcttttactggtataaaaacctgattgctacaaacggcgaaacactcgattaaacaaagaaagaggatgttcagatgatctctgaatatcctcttttttggtttgaaaatgctcattttaaaatttgcagaaaattttaaaaatatgaatgtaaatatctttaaagcgtgttacattcgaaacggaacgaacaacaatgatggaaaggaagaaagaacctatgaaattcaaaatcgaaacacttccaaactaccgcattgcatatatgcgccgagttggtccatacggccccgccaacattgaggtaatggaaagattaaaaaaatgggctaagaaaaaagatcttcttgaatccgccattctgtttgcgattccacaagataacccgaaaacaacgcctcctgatcattgtcgatttgatgcttgtattgtgataccgcatgattatcaagtcgatgataccgtttttgaaggcgaaatttccggcggacaataccttatttacgaggttgaacatacagcagaagctattcaaaaagcatattcagatattttctcatccctgcaaaacaatgaataccaattggacaataggccaatcatggaaaaatacgttggtgatatggtgaacagtccgtattgcgaaatatgtgtgcccttaaaatcggtttaattcgttttttttgtgtagttgtcacacaaaactttgaatctataaaaagagtttaacccgccgacagaaagggtaaatcataaaatagcattccagatcagctacatagggaataaaaatgaggagggatgacaagtgaataacaatgatggccgccgcaaagtcaatgggcacagcaaggatcaacaactcgaacagtaccggtctgacaataggggcaaaaaaatgacgacgaaccaaggtttgcgcgtatctgaagacgagcactccttaaaagcaggcgtgcgcggtccgacgctgatggaggactttcatttccgtgaaaaaatgacccattttgaccatgaacggattccggagcgagtcgttcatgcgagggggtttggcgcgcatggctattttcaggtttacgagccgatgacggagtatacgaaagcaaagtttcttcaagatccgtcagtgaaaacaccggtgtttgtcaggttctcgactgtcgccggttccaggggctcgggtgacactgtacgcgatgtcagaggatttgcgacaaagttttatacagaagaagggaactatgatcttgtcggcaacaacatccccgttttcttcattcaggatgccatcaagttccctgacctggtgcacgcctttaaaccggaaccgaacaacgaaatgccgcaggcttctacggcgcacgatacgttttgggactttgtcgccaacaatgaagaaacggcccacatgatcatgtgggcaatgtctgacagggcgattccgcgaagctacaggatgatggaaggcttcggcgttcatacgttcaggtttgtaaacgaagaaggcaaggcgcgctttgttaaatttcactggaagcccgtcctcggcgtccattcgctcgtctgggacgaagcgcagacaatcgccggaaaagatcccgactatcaccgccgcgatctgtgggaagcgatcgaaagaggcgatgaagtggagtatgagctcggcgtgcaaatgattgacgaagaagacgagttcaagtttgacttcgatatccttgacccgacaaagctttggccggaagaaatcgtccctgtcaaaatcatcggcaaaatgacgctgaatcgaaaccaggataacgtttttgcggaaaccgaacaggccgctttccatccgggccatgttgtgccggggatcgatttcacaaacgatccgctattgcaaggccggctcttttcttatacggacacacagctgatccgattgggaggtccgaactttcacgaaattccaatcaaccgcccggtctgtccgttccataacaaccagtatgacggctatcacaggatgacgattaacaaagggcctgtcgcttatcataaaaattcgcttcaaaacaacgatccggcgcctgcttcagaagaagaaggcggatatgtgcactacgaggaaaaagtcgagggcaaaaaaatccgccagcgcagcgaaagctttaacgaccactattcgcaagcgaagctgttttggaacagcatgtcccccgttgaaaaagaacatatcatttcggcgttccgctttgaagtcggaaaggtcaaaagcaaggacgtccgccgccaagtcgttcatatgtttaaccgggttgacggggagcttgccaagcaaatcgctgcgggtgtaggcgtagagccccctgaaaaagacgaaggctccaacgtgacgttcaaatcccctgcgctcagccaggagaatacggtgaaactgccgcagacaaggacagtcgccattttagcagaacaaggttttgatgatgaagacttgagccgtgtgttgaaagaattcaaaaaagccggcatcattccggacatcgtcagctcggcactcggagtaatcgaaggggccggcggcacagaaattgaagtcggaaacactttgcagacggtcgattctgtgctgtacgatgccgtttatattccgggcggccaagaaagcatagaacgcctgaaattgcataaagccgcatcggattttgtcaatgaagcattcggacattataaagcggtcggagccgcaggcgaaggggtcgatctcctgctgtccgccgccggggcccacgcggcttcacagccgggcattatcacctctcgtggtgataagaacaaagacgacttcggcaaaaagctggtcgaagcgatcagcgggcaccgccattgggataggcaagtttaataataaagcaggcaggctagatgcctgcccttttaatctatttttctaccaaacaaacagcccgacaatccccgcgctcaacagcgacactgctattccgctgacgaggagcttccacacatttcttccgataatcgccgatttttctccgttaaataaggaattgtacgttccatagatcatcccgatcgtactgaagttggcaaacgacgtcaaaaatgttgtggccacgacggctgtatggggtgaaatcgcgtctagctgcgtttttaaatccatcatcgcgacgaattcgtttgtggcgagtttcatgcccatcagctgtgcaacatacatcgcgtcgcccggcgccagtccaagcaggaatgcgaacggactgaagatataagaaaagatcttttgaatcgtcaaaccgtctacgatcaagcccaaaataccgttcaaacatgaggttaaagcgacatatccgatgaccatggcgagaatgacgatgaccatattcattccgaccatcatgctgtttgaaatcgttgagaaaaagtcctttttctcttcttttggcggtacgtaaataatgtcttcatccttagtgacttccaccgggtttaaaatgctggccaagatcaacgcatttaagcagtttagcgggatggcggtaaatacgtatgtcgcaggaaccatcgttaaataagaaccgagaatcgatccgctgatgctgctcatgctcataatgccgaacgtcagcaggcggttatcctttaatacagccaattgcccgcgaatgacggcgagcgcttcagtattgcccagaaacatcatttgaatcgaaaagaaactttctaatttaggaaggcgtgagactttcgaaattacccagccgatcttatcaatcatccatgttaaaattccgaaataagccagtatatcaaaaaatgtcacaacaaaaataatcggcagcaaggcgctgaagaaaaagtcaacggtttcattgcccatcacggacggaaaggcaaaagcgatgccgtcgcttgcacaagcgatcagccacgaaaagaaagaggcgatcaggttgatggcccatccgccgatttttgtcccaagcataaaccacgtcaccaaaagctcaacgatgaaaagggagagaatcggcctccattttacgcttttctttcgcggggaacaaaaataaattacagacatgacaatgaaaatgcctaaaatattaatgagaaaatacatgatgccaactcccgaatgttttttgaaaataaaaaagctcttatttttcatgggttccgataaagaaagcatgaaaaataagagcaaatgaaaaatagatatattgtttgcgcaatacactttttacatgatcaaatctattcaaacttccttgtagtctggcgatttacggttgccaggtagaaacaatcagaccctattactgattatatacaagaagtgggcttctattattttgactgtattttatctcgagattgtgtaaaattcaagctaaaaatatattttcacaataatttttcaaatgaagtcatgtctaggagagggtcagggcgcttgttgcttagtctttgaaagccggattttcaagcgggaaaaatgattgaagtgacgatgcacagaacaacagacgaaaaattgaaagtgataaaattctttttattagaggagaatcgtaagcgatcgcgctttatatcttcatgatgccgcctattatggcggtttttttgtgaaactttatctggaagttcccgtaagtatgatgaatcgtttcagtgctaaggcctcactgtaacatactaatgacaccgacaaaccttgcgtaatgagcgaacattaaatcaaaagtctctgatttaaataggcaaaatttcgcggtgctttagttcgttgaatgaaatgatacctttttgctatgatttccctatgtttttacaacttgtatgtatgtccaatttcagagaaaaagagggataatgaattatgctgttaaaaaagaactatcttcctgtcggcagtgttgtcggcttacataatgattcaaggcgtctgctcgtcatcgggcggcaaatgttttctgaaacaaatcacgtgatcagagattatgcagctgtcgactatccaaatggatttaccgatccaaaagagcagcttgttctatttaataaacaggacatagaagtggtataccattacgggtatgttgatcaaaaagaattgcagcttgatgaactgctaacagaagctgaagcaggaaaaaaagaaaataaggagcaatgacgatgggacattttcgcttcaacaaagaactttcacacaaggcagcgggaaccattagtcagctggaaaacgcctttagccatgtatttgagaacatggtgttttttcgtgaagaattagaccggcacagcggaaaagccgcagcagcgctgcagaaaaaaatgagcgacaacatcaactttttcagtaaagcaagcagctgtttattatattttgcagacagtgtacgctgttttgcaaaagcggtcgaactgacggacgaatccgacaagccggccaatgttcagccgcagtcgagatcagaaagaaaccatacgttttcggctgaaagagttcaaagtgaaattaaagtaaacggtgaatcgttacaccaggcaaccggaaagtttgaatcaaatctatctacacttgatgaagttttgcaccattttgacacaatgctcagagaaatgatgtatgaaacagaatttccgtgggaaaaattcgatgacgtctggtctgatgcaaagtcgcacatcaactcaatcatgacggagcttaaaaaaagagtcaaagaactttcggcaaatgctaaaaacatcgttaaggaattaaagcgcgtcgataacataatctcacagcaactgcaaagagtgaaatgatggaagggaaacagagttatggcttatcataatagagaaaaagaaatcacgaacattctcaaaaaccatgaaagaaaagcgaaccagctgctgcggttagcccaatccagccgtctgcttgatacttttaataaaatatgggtttcgatagaaaataaagaacttccgaattttgtatcaaaaaacgtaatggattttaatgtggcggatatcaaatcggaaatcaacgattggataaaggatttaaaagagtgccaggagaatgccaggcgcaaatttgagtctatggaagaccccacaccggaagacttaagaaaacgcaacaatatttcgagtgacgccgttcttttaattagccaatacgagaatctaaaaaatggcattgatcaggtggaacaagatttcagcaatgtcgcccgcacccaccgcgccccgatgcgcgaagctttgacagacctctcaatcttgtataattcagttaaccatgtaaaaggcgatttttcggattataagaatgtttctgtttatgtgcatgggattgaggatagtgggaatggtttctataaaagtgtaaaggatgctgcgaaaaagggcgaccttatcgttcgtattacaacaaatgaaaaaaacgaatatgtttatgaatactattatattgacaaatatggaaaaatgtatataaaggaaacttatgaagaaataaaaggtcttgaatacttcgacactaacggccgtctccatattgtttatgacacaaatgaacccaatgagcatcggcaagcaacaagtgacgatttagcagaaaagttaaatgagatggggctgatgaatgaggagacaaagatcgatatgttcgggcacagctatggaggaagaagatcgctgcaatttgcgatggattaccctgaccatgtgcgaagcatcacaacaatcggaactccatatgataaaaatctcttagctgccggggcaaatagagcgcgctggcttgcagataatgctgctggaagagatactatgaatacaagtgattatttagattttaatgaagaaaacaaaaacaatgataatggaaaagattacagtaatgcctacactgatatggactgtgaggcgatgactgaagatattaatcatttgaaatctgccaatcctgaggtgtatcaaaagctgcagaagatggacattaccgctgcggcgggatacagaacagaggatactgtaagtttttccccttactataccgcaagcggaaaacataaaataaacagtgatgatatcgtttcggtcgaaagtcaacacggtgacatattaggcgatctcattgataaaaagccagaaattgaagtaagaggttccggtgtaaccaatcctggacatatttatgaaattgaagactctgaatttgttgacttgattcgagaggtcaacaaaaaagaagcagaataggagaaggtcgatgaaaaagaaagggtttataagtatattttttttaatagtgtttctactgctcgccaccaccggctgcggcaaagatgatgttcaggaagccatctataaaaaaggcttgcccaaagaagacagtccagcatttagagaatttatgagacatgaacttgatttagcgacagacgcaactcttagttatcaaaatagtacatatacgattatgcgcagtgataaaaaggggctacggtactatcaatatacagatcaagaagtagacgatttttacagtccctttctttcggctaataaatatcctgcgacaaaattatatgatttgaaaacaactgaatttttaactaaagaaaaacttatccacaataaacttgaatataatctgccggaaatgacattagataaaaagaatgttctaaaagtgaaaacaaaaagcggagaaaaaaaaatagagtttccatcagccaaggataaaaaagtacatctggcgttagcagctgttagcaaagacagcatgcttatacaagtggacgtatatgaaaaatttaaaaatggtgaccttggagacagacaaatatattatctttttttaaaaagtgatctttcaaaataccggattgttaaagaagaggaattaaattcaacaattgagtctgggaaactgaaggaatacttatccgtatttccaaatgtagcgaaggatggagcatatcgtaagttatttgataaatacatttttgatgaaaagaaaaacaaagttaggaaaatcaaaaacactgatattctgagcaaagacggtaagtatgtttatattaacggagcaaaagaaaaagaaacaaatgtaatgcctgatggtatccaacagatacaaacaatggataattatctaaaaggaaatgaaaaatatgaagctcaatttaagattgatttcaaacaaattgcaaaagagatggatttaaacgcgggtgatgcgaggatagctaatattcattattttaataaagattatgtagttttgtatatttcttatcatgggaagacaattggtacagcaggttctgttaatgtacttattgatttacaaaaaaacaaacaacagccaacggcttatttagttgatttaggaattgaatcatagagggactgaagagtttttatgcagtccttttcttatttgacaaaggtaggccacaaaattgggacaagccttctgtaatttttggaactcaaataaaaacatttcaatggcctgccgatgatcaccaactaccgcaaagccgatggagaaaaaaccgcacccccatagttagacactatccaactataggggtgcagttcattttcacccttgcttcaccttctccgacgcatatccattcggattcgcagagtgccagttccaggcgtcgcggatgatcgcgatcaggctgttgtgctgtggggtccagcctaattcttttctggctctggaggaagaagcggcaaatgttgcttgtgaatcgatgtccgtttctgtcagctttgcggcgatgaggggaatgcctgtgacatattgggcggcaaggatgatttgttcagcggagtagctttcgccatagctgagattgtagattcggctatccttgcctttccgcaagtgactgatggcgagcacgtgtgcttctgccaaatcttgaacatgaacataatcgcggacgccagttccgtcttcagattgatctatgtgaacaaaaggaaggtgtccgagagcggttcgcagaacatttgaaatgagatgtgtttcgctcccccggtcttcgccgatgatggcggatgggtgagcgccgcacgcattgaaggagcggaggatcacatatttcagcccgtacgctttttccgcttccatcagcattttctccatcatccatttgactttgccgtgcgcgtgaacgggctcaggttcggtttcttccgtgacagggaggtcttctggactgccgtagacggccgcgcttgacgcgaaaacgatccggccgacatcgtattctttcatcacgtcaagcagtgtttccattcctgtgatgttttcgttaaaggaagtaaacacgtttttggatttcgaggaaatcggagatgctgcgaaatgcatgacggcttcaatgtcctcgttttcaaatacttgcttgagaaaatgccggtcgcgaatgtcccctttataaaacgcagcttcggagtgaacggcttctgcgtgtcctgttgccagggaatccacaacaacgactctttcttttttctcaattaacgtgtaaacggcgtgggaaccgatataacgggctcccccgacaactagtacgctcatcggaatccctccttttggatctttctacataatatggcgctggggagctcgcgcccgccgctgttcttcaaacccgtattttccgtcaatgatataaagcggcctgtctttcacttcgtcataaatgcggccgatgtattcgccgattgccccgaggatgatcaggataaatccgctgaacaagcattgcagaatgatcatcgacgaccatcctgtaatggtgcttgtcgtaaacagcttcatgcagacgacgatgaaggcgtatataaagccgatcgctgacagcacgattcctgagtagcttgccagtttcagcggctgaaaggaaaatgaagtgatgccgtcgagcgagagcttcagcatttttttcagcgggtacttcgtttcccctgcaagccgttcgtggcgctcgtaatagacggctgtctgcttgaacccgagccagctgacaagaccgcggacgaacgggtttttttctttcagcttgttcatttcattgaccaccttccggtccatgagccggaagtctcctgtatccaccgggatatcaacgtctgtgagttttcttaaaatccggtagaacatggcggccgtttgctttttgaaaaatgtttctccttctcgctttgtgcggacggcgtatacaacgtcaaagccttggcgccatttttccgccatttccaaaatcaattcaggaggatcctgcaaatcggcgtcgatcacaacgatcgcctcgccggcagcatagtctgtgccggccgtaatcgcgatctgatgaccgaagtttcttgagaaattgatgcattttactgcctggtctgactgagcaagcgacttcagcgtgtgaatgctgtcatcgcttgaaccatcgtttacaaaaatcagttcatagggatcgcctgtcgagtccatgacggtttttaatcggtcataggtgctttgaagcacttccgcttcgttgtagacagggactacgattgaaaatgtgacttgtttctgcatattcatcacctttcctttcatcaatccagctccactttataaagcgtttgatttccgccaggtccgcctgactgtgaatcatcagaagaagagctgctgtattcgctttttgaaatttctgtgccgttttctttaatccagttggtgatttctgaattgtcccggcctcggccgtcgccgatcatgaagtacttgacttcgccgtttttgacgagcttctcaagtttttcaaccgtcaaaatcgggtcgcttcctgagaatccgcccatcgccatcacagctttgcccgttttgatgatgtaagattgagcagaagttgcacttgagactgcaaataaatatttttcaccggtgttgttcttttcaaggtagctcaacagttcttcatcgaccgactcgccgcttccagggctgccgccgccgcttggtctgccttgttgacggccgcttgcgccttcgtcattctgattttggctgttttggccggaaccggtatcagctgaagaatcgttgctgttttggctgtttgaacctggaccgaagccagggccattattgttgttttgattactgtctgtttggccgtcttggctgccaaatccgggaggtccgctgccgtcgttattctgcatcttacctcctccgccaccgccggcaaatgattgtgcggatttaggtccggcctgtggaatcatgccgtttacaccgtcagcaagcgtcgccgttgtccaatagaaaggcccgatcagcatgccaagcagcgctgcaagtgatacatagtagctgaatgactttcctttcttgagaaagatgagaagacagcttgtgacaatgccgaaagcgccgatcaatatgctccagatgaagccgatttcgctgagataaggactcaaaatatacaattcaaatgcggttgtcagcaaaatgccgattggcagcagccgttttttccagccgctttcttcctgatagaggcgaacgagcgccgtccagcctgcacctgacaaagcggcgattggagctgccagcataatcagatagtaatgatggaagaatcctgcgatgctgaagaatgcagcgaccggcagaagccacatcatccagaaaattgtttcagtcgttgtttcattgaattttctttgtctgcgaagacccgcgatcagcaaaccgatgatgccgaagaggacaaacgggatcagccagctagcctgtcctgaaagctcagattggaatagtctgagaggacccggggttccagtgccaaacatgccgcctgtgccgccaccgggacctccgccgccgctttggacatcaccctgccggccatccggtccgcccgaaggcatttcgcctccgctcggcggagccatttgtccatttgccgagtctgagttgttttcaatatcgccgctttgctgctgattcttttgatcatgatcagatgaggaggttccgcccccgcctgcaccgttttgacctgtgagacgctggatgccgttatagccaaacgccagctcaaggacagagttggtctggctgcttccgatataagggcgcgaactctcgggctggctgtcgacgacaaccgcccaggaaacggaaacacctgccagaacgatcacggctgtgataagagacacaacttttttgcgaatcgtcgttttggctccaatcatgtaaaacagcaggaatgccggtaataccatgtaagcttgcagcattttgacgttaaaaccgacaccgatcatacagaatgcgccgagcagccagccgatttttcctttccggactgctttaaacaacagccacgttgcaatcatcaagcaaaggacgagaatgctgtcgacgttgtttgtatggctgaccgcaacggcaatcggcgtacacgccataataagagctgaaattctggccgccgttttgccaaaagtaggttttacaataaagtacaagagtgctacggaaatcacttccgcaatggcttcagggagaacgacgctccagccgtgcacgccgaatacaagtgcaaaaagtgtctgaatccagagtgcgacaggcggtttatcaactgttacaaagcctgccggatcaaatgatgcgtaaaagaagttatgaaagctttgggtcatactttcaacggccgccgtatagtaggcgttgtctgtgtcactattccagatgccgtacaagtttaatgctgcagataatacaagaatgaagaccaggaatatatcgattttccttttcttaatcattgttcgatcacctcactaaagagcattatagaagccaaatatgatcaaactatgaacaaatcaagaaggaattttaaattgtatagaggggcaaaaaaagagacatgccgtcaggaggcatgtctcaaatatgaggtgttatttccatacgtcttcagcgatctcgacgacatggcgcagtttttcccactgctgttcttcggtaagcaggttgccctcttccgttgaagcaaagccgcactgcgggctcaagcacagctggttcagatcggcatatcgggacgcctcttcaatgcgccgcttaatatcatccgggttttcaagctcgccgaatttagatgtaattaaaccgaggacgatttgcaagtctttccgttggacgtagcgaagcggttcgaagccgccggagcgctcgtcatcaaattcaaggaaaagtccgtctaaattgagtccgtcgaaaatcgtttcagcagccgcatcgtagccgccttccgccacccatgtcgactggaagttgccgcggcagatgtgcatggtgaccgtcaaatcgtccgggcgcccttcaactgcttcattaatcgtgttggcgaaagactggcgcagttcatcaggctggcggccgaaagctttgatctgctcatgtcctttgtctgagaaaaatacggaccaggccgtgtcatccagctgcaaatagcggcagccggcatcgtaaaatgcgcggatcgcttttttgtaagcctgagctacatcgtgatgaaattcatcaagatcctcatacgggctttctccaagctttcctctgaaaaacagcatattcgggctcggaatcgtcattttcggcgtatgtgtgcccgcaatatcatgaagaaatttataatcttccagcatcggatggtttgtaaagtcgactttgcttgttactttgatgccgcgcggcttcgtttcaacattatgaaattgaatgcccttgtccgctgtatatccttctacgccgtcaagtccttcaagaaaatcgaaatgccaccatgacctgcggaattccccgtctgtcacggctttaagaccgatttctttttgcttttcgacaatgcgcttgatctcttcgttttcgacttcgcgcaattgttcagcgctaatttcgccgttcgctttttggaggcgcgctttttttacgggctcagaccttaaaagactgcccacctgatcagctctgtacggtccgatttttcttccaggcgtttgcttcagtacatcggttgattgtgtcatgcttcatccctctttctttatagacataaaaaagctcttcccgataaggaagagcttgatatattcaatctcctccttatcttcaagagcacgaacatgctcttaaggatttagcaccattctgtcatagacagcggttgccgggtttcacagggccagtccctccaccactcttgataaggaaaacctttttatgcgattttttaatagttttaatattaatactttttataaaaatgtcaatgggtttaaaaaaactcttcgtttttttcattttcttcttctgcggttaaactggagggcgtatcgaatcaatgtgtgaatttttcgtcaggacagccgttcaaacagtcaacaagatgctgaacaaacagaataaattagaatttttttcaatttttatttccaaaaacagaaactttttattgagttcaccggtctataatgtgtacctgatttcaaaatgggtattataaaaaatgacagattaaggagggtttttatgaacaaaaaaacagtgtttaaagcgttcggaatgttgatgacaggggtattgttttttgcgctgtacagtgcggccgcacttccttctgcacacgcggcaaacgaaaaaaaaccgacggtcacgagccatacgtacaaaaacattaaggctttgaaatacccgcaagtttcaaatgtaagccccaaatctctccaaaacaagatcaacaaagattttaaacattatattgagcagtcctacaaagattatgtaaaaaacaagaaagacggccaacagcacggataccaaacggattatcaaacgtcctttgaagtgaaataccggaccggccaaaagctgagcatcctgacaagcaattacgtctattccggcggagcgcacggaaatacggcagtccgctctttcaactatgaccttgtctctaaaaaacgggtgtatttatccgacatcctaaatacaaaatcgaaaatggataagacaaaaacatacatttacaactatattcaaaaacacagcgacattttctttccggatgtgaagaagaaagacatcgtcctcggtaaaaacacggccttctattacactaacgacggcattgcgatcgtcttccaacaatacgatgtcgccccttatgccgccggaaatccggtcgttgcagttccgaaaacggtgtatcaataaataacagcccctgtttctcaggggtttttattatgagggaagaaggaaggaggaggttttggaagctctttcataaagcggcagctgacgggcatgattcagcccgcagtcagtttgcagattttttctaaatcaaacagttcgcagacatagaacatgcactgtcggccgctgatgatctggtattttttaaaagcatatgtccggtctgctgaaacaggtacaagttgtgtgaaatgttttcccaggcagtcgcccgtgctgaaaatttcacgccttgactccagttctgcaatgattttcccgatgggaagcctttcttcctgcaaatcttgtttgatggcgggcggcagtaagtttgttttgacatagacataattataagataaataatcatcgcctgttttcaaagacgaggttctaaacaagatgtcatcatcgcgttgaaacagccttgcttcctcaggtgaaagcttgtcataatcaatattattttgctgaaaaacttcgatttcggctttgccgccgatcagcgtttcaatcgctttggttgttgaaccatccgttttggtcagcatgtctttcacaagggaagtcagcggttcaggaagaactttgctcatttccaattatggcaccccacttaatgatagaatattttgaaaacttgtactatacattatcacacagagggtggcttgtctagaaaaataagttaaaatttatcttatttttacaaaagtcatagaaagcaaaagaagtgtataggagagataaaagctggagatctctccataacatgatgtgaatattaagttgttttaccctccagaacttgaactggcaaataggtttcacgcggcaaatcgttaaaatcaccatcgaccgcttttagcaagatttcgattgcctttttcgagattaattcaataggctgctggatcgttgtcaaatcagggagcagcgactgaaccgtttccgttccatcgtaaccgattacttttaagtggttgggaatatctatgcctcgttttttggcttgattcaagactgcggcagctatgaggtcgtcactagcaaaaatgccgtcagcattaggttgttcatcaaagagccttgagatatattcttgataattttgatgaaaaggaacttcatatgtaacaggctttcttccgtgttctttcatgacatcttcatatgcttttctcctaagatttgcaggtgtttcaagctcgagcggcccattaatatgaacaatgtgcttgcaccctttttcgagcagtaattctgtcgccttttttccgccggcatagttgtctgatcccactacggggatatgattggataaatagtgatcgattgcgacaatcggaagattttgtttgtgataatctaaaatgcccctattaaacgttacggcgataacgccgtcaacctgatttcgtatcagcatttccaaatacttctcttctttatccttgcggtttaaactgttgcaaagaagaagtttatacccttttagcgtgcaaatgctttcgatatgaaaggccagttccccgaagaaaggattgctggagttcgggatgatgaggcctattaaatttgtgcgttttcggaataaagagcgggcaaggtcgtttggaaaatagttgatttcttccatcgccttgtacactctttcttttgttttttcgctgatataaccgcggttattcagcacccgtgaaacggtggttggtgaaacacctgctatttttgcaacatcgtgaatgttaggcttcatgcccttgccccctgtgttatcgaaatggcttacaattctcatcacgcacttattttagagaattgaaccgctatgtgcaaggattttccatgaatcaccacgaggccttatttttcgcttttgtaaaaaagtatgtcaaccggttgacatatgaaactggttgacataaaattcatttgaaagcgcttttaaattttgttggaacgatagattgaggagaaaaagtggctggcgtggaaacgtccatgtgaaaaacggcatttcaagaaagcgttttttcaggatggattgtccaagacgattcaaagctggcggaagcgaatgcaacatgttaaacatccgtcttttcgtgtaaagagaggcgcccggaatgcggaatggcggcacaaatgcaaatgcagttaagcagttcaaataatggtcaagggagcagtgaaaatgaagggctcaaaaactctgtattggaaactaagcgcttattttttctttttcttttttacttggtcttccagctattctttatttgcgatttggttagggcaagaaatcaatttgaacgggtccgcaacgggcattatcttttctgtaaacgctatctttactttgtgcatgcagcctttgtacggttttatctccgataagctcgggctgaagaaaaacatattatttatgatcagtttgctgctcgtatttacgggtcccttttatattttcgtctacggaccgcttttgcaatacaacgtctttcttggggctatcgtcgggggaatttatttgggaactgcttttctcgccggaatcggtgcgattgaaacctttattgaaaaggtcagccgcaaatatcaatttgaatatggaagaacaaggatgtgggggtccctcggctgggctgcggcgacattttttgcaggtcagctgttcaatatcgatccgaatatcaacttctgggttgcgtccgcctcagcaatcatattggtggccattattgtttccgtaaaaattgagatgacagatgatgaaaaggaaagagcagactcggtcggattaaaagacgtaggagggctttttctcttaaaagatttctggtttttgatgctgtacgtgatcggcgtaacatgcgtgtacggcgtctatgaccagcagttcccgctttactacgcttccttatttccgactgcggccttggggaaccaaatatttggataccttaattcattccaagtatttattgaagcgggcatgatgtttcttgcgcctttcatcgtcaataagctcggtcctaaaaaaagcttgattttagcggggctgttaatggctttccggattatcggttccggacttgtcagcggaccggtcggaatttcatcgatgaaactcattcatgctttagaattgccgattatgctgattgcgatgtttaaatatttggcgactaattttgataatcgtctttcatccgtactttatcttgtcggctttcaattcgcatcccaggtaggcacgtcgattttttcgccgcttgcaggaggtttatacgacagcatcggatttcgagagacttatctcatcatgggagcaatggtcctttgttttaccattatttcgatttttaccttgctagactcaaagaaagatgttgaatttgctcaaaatctacaaagcaatcatatatagagaggatgtcacagatgaacagaattcagcaggcagaagaagcattaaagaaagccgggaaaaaagtgaatcgccgttaccgaatgggctatcacatgatgccccgggcaaactggataaatgatccaaacggacttattcaatataaaggggagtatcatgtcttttatcaacatcatccgtatgatgagaattgggggccgatgcattggggccatttgaagagcaaggatcttattcactgggagcacttgccggttgctttagcgccgggagacgaatttgatgagagcggctgtttctcaggaagcgcagtcgaatataacggcgacctcgctttaatctatactgggcataatatgatagatgaagagaaagacgatttctaccaaactcagaatatagcagtcagcaaagacggtatcgtctttgaaaaactgaaagaaaaccctgttattgcagagccgccggaagacagcgcacgtcattttcgcgatccaaaagtatggaagcatcgtgagaactggtatatggtggtcggaaactcctcaaaagagaacgtcgggcgggtcatcttataccgctcgcctaactttgtagattgggagtacgtaggcgttctcgcccaaagcgacggaaatctcggctttatgtgggaatgtccggatttctttgaactagacggcaaacacattttgctgatttcccctcagggtatagaggctgatggtgaatcatatcaaaatctgtatcaaacaggctatttgattggagactatgatgaagaaacgaatgagtttgtacatggctcctttaaagagttggatcacggccacgacttttatgccgtgcaaactttattggatgacaaaggccgcagaattgcgattggctggatggatatgtgggagtcagagatgccgacgaaagcagacggatggtgcggggcattaactttgccgcgtgaattgacgttgaaggatggtcacaaaattttaatgaatcccgtcgaggagactaaattacttcgtggatcggaacatcatgagtgtgacaatcaatcgatttccggcagctattttataaagacagccgaaaagcttcttgaagtggtggccgtttttgatttgacaatttgcagtgccgaaacggttggcttaaagatccggggaattgaacaggaagaaacaaccatcaagtacagcttgattgatcaaaagctgacgctcgactgttcaaagtccggcaaagcgagggacggtgtgagaaacgtacggcttgaagcggatgagaagctcactttgcatctgtttctcgacagatcgtctattgaagtatttgcaaatcatggtgaagcgacaatgacaagccgcatatatccgaaggaaggaagagcggggattgagctgttttctgagaaaggcaacgtacgggttgaagaattcacttactggacgttgaaagatatttggaaaggtgatgaagccaaatgaacagaattttttgcatcggtgagatgttaattggctttatcccgctccaaaaagaaaccgccttgcaacatgttctaatttcagcaaagcgcagataaagattgatctggaaaaaaagcggctgctttgtcttgcagccgctttccgcttttttcgtttaagctctttcttcaaacagcttcacaatttccacgatgacattcgcggcttttaccatattgtcggcggaaatatactcgtattttccgtgaaagttttccccgcctgtgaaaatgttcggacaaggaagccccatatatgagagctgagagccgtctgtaccgccgcggatcggtttaacgaccggttcaatatcaaggtttttcatcgctttataggcaatgtcgacaatctctttgaccggttcgatcttttccctcatgttgtaatattgatcattcatgtccactgtgacgctgttttcgccgtatttcgctttaaggttgtttgcaattttttggacggtgtcttttctctcgttaaatcggtctctgtcaaaatctctaatgatataagagaggctcgtttcagaaacatcgcccttgattgaaagcagatgataaaagccttcataaccttctgtaaattcaggagcttcgttttccggcaatgcggcgtggtactgcatcgcgattttggcggcattgaccatttttccttttgctgtgccggggtggacgttcgttcctttacaagtgattttcgcggctgcggcattgaagctttcgtactgcagttcgccaagcggtccgccgtcaaccgtatacgcgaatttggcattgaacgcctcgacgtcaaacttgtgcggccctctgccgatctcttcatcaggtgtaaaagcgactctgatcttcccgtgtttgatttcggggtgcgcaattaaatattccattgccgtcatgatttcagagatcccagctttattgtcggcgccgagcaaagtcgttccgtcggttgtaatcaacgtatgtcccgcataatctgctagctcggggaattccttgggcgataagacgacattgagggattcattcagcacaatatcctttccgtcgtattgttcgataacctgcggattgacgttctttccggtaaaatctgttgctgtatccacatgagccaagaaaccgatcgtcggcacctctttttctgtattcgaaggaagcgtcgccatcacatagccgttttcatcgattgtgacgtccttcatgccgatctctttcagctcttcgacaagcatattggcaagcgccagctgcccgggagtggaaggcgtcgtctgactgttttcatttgactgcgtatccactttcgcataagaaatgaggcgttcaatcaatttgttcttcatgtttccttcatctccaattgttggttttatgtttatcttatcattcatggcgggcgaatcgaaaacttttattcctgtgtaggaaaatttagtataatatagttctaaaggatcatcacaattgtaagggagtatcaaaatggctaaaggttatacaaatgaaggaacgaaatgggagtttgcacattccttctggcttgtgttcacatgggttccttttggatttttaagctggtttgcatttatttatatcgcagcgcgaactaaacaaggaaaatggttatttgccggaatcggatacgcagcggcggttttattggctgcctttacagccagaacgttcctcttcgatttggcaatgaaagcattactcattgtttggatcatctcaatcattcatgctttcaaaacaagagccgaatatttggtgcggcttgaggccgtatatcggatcaaacgatcaagtatgaatgacctgagggaagagcttatacatgaacaggccccgcacggccaaaccggaacttctaaagtgacgctgacaaaaaaataaatagaatccgctattttcagtgaaatagcggattttttaatgcagagaaaaaattctatccttttgaaacttttctcatcaatttccctctctaatgtttgaaggaggcgcagcagtgaagcaaatcagattagttaagaaagctgtcgcaggcaacgccaaagcttttgaaatgctgtttcaaaagcacagcgaacagctttacagaacagcttacatatatgtgcgaaataaggaggacgcgttagatatcgtacaggaaacggcgtacaaggcatttttatcgattgcccagttgaggaatcccgaatactttttgacatggctgacgaaaatcctcattcatcatgcatatgccatattggacaagaaaaagaaagtggttttaatggacaggccgctgcaggacgaaggccgggagcaggagatgcatgcggacgacagaatagggatgcttgaagctgttcagcagttgcgaaaagaatatcaaaccgccatcattttattttattatcacgacctgccgattcatgatatcgccgaggtgatgaatgctcctgaaggaaccgttaagacctatctgaaaagagcgaagcttgaattaaaacaactactgactgggggagaagacgcatggacaaacaacggttcaaaaacgaagtaaacaagatcgatgtccctacaaaagaaatccgcgaatcgattgataaaggcatcaagcgggccaagcgggaaaaaacgtttcggccgaagcgcgccgtgaaaaggactgtttttgtttcgagcgcggccgccgtgctccttctcggtagcggcttcgtttccccagcgatgcaaagcgtgttggctgacgtcccgctgattggaaaagcgtatcaacaattccatgactatgtcggccaaaacttggtggcgggccagcttgtcactgaactgaacgagaaagcgtccagcaacaacatagacgtgacagctacaagcgtttattttgacggcggaatcatcggtatgacgtttaaggtgaaaagcgatacaagaaaagatttagatgatggagcgagaatgattcatttcacattatttaatggcgagcgcaaatgggctatcgcttctcaaggagacttgaagaaaacagaggacggctataccggctacattcaagtaggctatccagacaaacatattcccgataaactgacactcccggttacgatcacaaatattaacggaatcagagggaaatggaagttcgacattccggttgataaactgccgtataaaacgctccacataaccaaaaacaatacacaatcggctgatggccataagctcgccgtaaaaacggtaattctcggaaaagaatcgactgtcatcgactatgaagtatccaattcagaggaacatccgaacgatcgtacatcggttataaaagtgaccgatgataaaggaaatgaaattccttatttgagtggcgggcagtggacgacggacagtacaaagaacggaaacaaggttcgtcacgaagaaaggctgatccttggaaaagtgaataaaggaacaaaacacctcaagattgaggcgagcagcagtatgggcgattccgaaaagacgctgcctctcacaaaaacgcccgccgcgctgagcgctgaccgtcatgacttccagattgccgttgatcaggtgaaacaaaacggaagtaaattgtctgtcgactatcatctgaaacatgtcgatcaatctaagattgatattgacagcatgcaaaactttttagaaacgatgtcactggttgattctgcttataaaagcattgacgaagcgccgatgggacacagcgtaaaaggtaattttacaaaagtgcttgatcctaaaaagctccgattccgatcagactttacgttagatggtgaatttggagcgaaaaacttcagccttgaccgatattcgcttgatgtcgaatttggttatttaagcgcattttattctacaccgtttaagccgatcaaagtgcagttgccacagtaaaatatatgacccgctgtttcagtgaaacggcgggttgtctgctttgctggccgtccaacctgaaaaatttcctctcccaaaggaaaaaatatgcaccgaaaagaaagcgttttcattgtaaagtaaaagcaaaccaccaaaaaaagggggagagtaaatgagcaggatggcgaaggtgactgagatgtttgagcgggtcgcttttaaaattacaagtttcaaatatatcatggtcattaagtcggcgtttgtcacactgatgccggtcatcattgccggggcgtttgcggttttgatgcagaatatggtgatgagccccgagacgggacttgcggttttcaggccttttcggttcttgtctgcgcttgagccgattatggcgtcaatcaattatgcgacgctgaactttattacgatcggcgcggtgtttttgatcgggattgagctcgggaagctgaatgggcatgaatcgttttttcccggcttgatggcgctcatgtcctatatctctgtcattccatcggcggtgctgttggaagtgaacggttcgatgcaggaagtggttaacgtgctggccaaggaatttacggatccgaagtcgctgtttttggggatgtttatttcgattgtgtctgttgaaatcttcagcaagctgtcaagcatggaccggctcaagattaaaatgccggacagcgtgccggcaaatgtctctgtatcattcggcactttatttccttcgattattaccgtcacgatcatcgccagcttcggatttgcgtttcatcggctgacgggggtatatcttcatgaagccgtgtacaatgtcgtgcaaaagccgcttgagggcgcgattcaaggtcttcccggcattctcttgctggtgtttgtcgcacagtttttctgggtgatcggcatacatggaaaccagatggtgaagccgatcagggagcctttgctgctcgcttcgattaccgtcaatatgaatgcatacgcagccggcgaatcgattccgaatatcattacgatgccgttttgggatgtgtacatgagcatcggcggatccggcgtcacaatcggtctgttgatcgcgatgtttatcgcggggaaacgggaggatttgcgcagcattacaaagatttcgtttggtcccggcatcttcaatatcaatgaaccggtcatctttggggttcccgtcatgctgaatccgttaatggcgattccatttattgtgacgccgcttgtgacgggtgcgatcggttacatcgcgacagcggcgggctttgccggaaaagccgttgtcatggtgccgtggacgacaccgccgattatcaatgcctggctgtcaacaggaggaagcctcggtgccgtcgtcacacaaatcgtatgcatcatcgtctccgtccttatttatcttccgtttgttattttattgaatcggacctttacgattagttctgaaaaaaatgtgtctatgtaaagcaaagaaaggtgtgaatgagatggccagacaaacgtggaagattcccgacgattttattctcggcgcagcagcgtcggcgtggcagacagaggggtgggacgggaagcggccgacacaggattcctatttggatatgtggtacaaaaatgatcctgatgtatggcatgacggatacggaccggctgtggcaaccgatttttataaccgctacaaagaagatattcaatatatgaaagacatcgggctaacccactaccggacatccattaactggtcgcggtttcttttggattatgaaaccgccgaagttgacgaggtgtatgcaggctacattgatgacgtcatcgatgagctgaagagatgcggagtagaaccgatgctttgtcttgagcactacgaaatcccggctgtcctgctggaacagtatggcggatggggatcaaaacacgtggttggcttatttgcggcttatgcagaaaaagcgtttgaacggtatggggacagggtgaaatactggtttacctttaatgaaccgatcgtgccgcaaacacggatctaccttgacgcacttcgctatccgtacgagcagaacacgaaaaaatggatgcagtggaactaccataaagcactggcgacagcaaaggccgtggcaattttccggaaaaggaagcccagttttagagaaggcgcaaaaatcggcgtcatcttaaatcctgaggtcgcgtatgcgaggtcaagcgcgccccatgatcagaaagcggcccaagtttatgatttgttttttaacagggtttttttagatccgagcataaaaggcgtctatcccgatgaattgatggagctcatggccaaacacgacatcctttttgaccatgatgaagaagagctttccgtcatcaagcggaatacggtcgattttgtcggtgtgaacctgtattatccgaagagagttcaagcgccttcaaggcaatggaatgaatcgacgccttttcatcctgcttattactatgagccctttgagctgccaggcagaaagatgaatccgttcagaggctgggagatctgcccgcgcattgtgtacgatatggctatgagacttaaatatgagtatggaaatatcgaatggctgattgctgaaaacggcatgggcgtcgaacatgaagagcgttttaaaaatgaagagggggtcattcaggacgactacagaatcgattttatttcagcccatttgcgagaggcgatgaaagggatcgccgacggcgcaaactgcaaaggatatatgctttgggcattcacggacaacgtctctccgatgaacgcctttaaaaaccgctacggccttgtcgagattcgattggagaacaaccgcagcagggcgctgaaaaaatcggcttgcttttatcgggatatcatcaaaaacagacggtttgaaacagaggaattccggtataaataaaaacggcggggaatcatcccgcttgtcgccgggatgatttctcatatatgcctacataaaatattccggccgattgatcatgatctgcttgttcatttgactgataacgccttcgcagcggagctttttcaggacggcgctgacggtttcgcgggatgtccccgagattttggcgatttcggcagcggtgatcggacagttgatgacggttgagttgctttctttttgaccgaggctttcggttaaataataaatggcttgtgtaaccctgtcgtgggcatgggagagtgtgatgcgcttcagcctttcctcgtgaagggcaaggatgtctgataaatgattgagaatatcgtaaagcaggtttttgttgtcccggacgagatcttcgaagatgttcatgggtatatagtagagttcaatatctgttaaggcttcggcggcatagtgataatgctcatcccgaaacaagcctccaaatggaaagagggtatgaggacgtacatagtcggtataaaacatggatccggcttcgtttgatttttcgagtttgataaagccgtcgagaagaaggtacattcgttcccgggggtcgtcttccataaataatatctggcctttatggtaagagcgccaatagataaactgtttcatatcttccagatctcttttattcagggaagcgagaagaggaaactttttcagctgatgtacgatgtctttgttcttcatatggaccacccttatcgattttcttatgttgcggctatatactttaaattttacttgtttttgacgattggcaaaaggaagaaccctccctgagcccttccttttgcatttaggcttggacgacaatcgtgccggcatttccttggagagcgtctttggctaatttcagggatgtgatgaccgttttgttgccttttttagcttcagcaaactgaatggctgctttgacttttggcagcatgcttccttctgcaaattgcttttcttttatataacctttcagttcttcggtggtgacgcgtttcagcgcacgttctgtcggctttaaataatcgacggcaacatagtcgacacctgttagaatgaccagttcgtcagcctgcacaagctccgccagtttgcaggctgcaaagtctttgtcgatgacggcgtcaataccggagacggcatcgccgttttcgatgacgggaacgcctccgccgccggctgcaatgacgatatgtccgtgttcgacaagatcattgataacatcgtgttcaagaatcgataccggggccggagacggtacgacgcggcgccagcctcttccggcatcttctttaaaaacgaggccgccgtttcggctgttcatcagttctttcgcttcttcttcgctgtaaaatggaccgatcggctttgtcgggttgcggaacgcttcatcatcgcttcgaacggcgacgcgggtgatgacggttgccgcatgtccgcctttcccttttgcgtgaagcgcccggtcaagggcattttgcagccaatagccgatcattccctgggtcatcgaaacacaggtttcaagcggcatggccggcgttttcggagaatccgcctccttttgctggatcatcaggtttccgacctgcgggccgtttccgtgcgtgatgattaattcagcgccgctgtcgatcatatccgccaaatacatggccgtttcttcaagcgcgcgcttttgcgcttctgcgctggcatctccggtttgaatggcattaccgccaagtgcgacgacaatttttctttttttcatttaataatcacctctgttttgttaaattgaaatgcttcccgaagccagtctgatcacggcgatcacggccaatacaagaatcagggcggcaatcaaaagctcggctttattgaagactgggccttcttttcctttgcgcacagcccggaatacgagaatgccgggagcgtataaaatcatggtcaaaagcaggtaatcaagtcccgcggcatatacgagccagacgccgtatatgcttgcgatgatgccgatgatgagatttttgccccggttaggctctttgtgcagccagctgtatttaagctgataaagcccggaaaacagatacgggatcaagatggccgaggaagccaaggaaaatgcaaactggtaggccgcatctgaaatgagaaacgtcagcaaaaacagctggataatggcgtttgtcaaagtcagcgcatttgtcggcgcaccgtttttattttctttgccgaaccatttcgggaagaccccttcgcgtgccgcgatcagcgggagttcgcccgcgaataatgtccaggccagccaggcgcccaatacggaaatgatcaatcccaggttgatgagcacggttccccatttgccgacgatatgctccatgatcgcggccattgaaggattcggaagctcggccaagttttgctgattcatgacgccgagcgacagcatcgtaatcatgacgtaaatcacgagtacgctgatcaagccgatgacagtcgctttgccaacatcgcttgatttcttggcccggcttgaaaataagacggccccttcaattccggtaaacacccagacggtcaccagcatcgtgctcttgacctgtgttccgatggaaccgagcgacagcccttttccccagaaatcgttcgtaaataaatcaagatgaaacacaaagataatggcgataatgaaagcgaaaatcggtacaagttttgaaatggtcgtaattaagttgatcatggcagcggactgaacaccgcggaggatcaaaaagtgcacgcaccagaggatcacgcttgcaccgataattgatgcgatgttttgtccgtctccaaacgcagggatgaaatatccgattgcgctgaacagcagcgttccatatgcgacattgccgagaagggctgcgaaccagtacccccagccgctgttaaagcccatgaaatggccgaatccttcccgggcataagtgaaaataccgccgtctaaatcaggccttttcgtcgtcaagttttggaaagagaatgccagggcaatcatgccgactccggtgatgatccagccgattaaaatggctcccgcccccgcccctgaagccatgtcgcttgcaaggttgaaggcgcccccgccgatcatcgatccgatgacaagcgcgatgagcgcaaacagcccaagttttttttcttccgccatttttgtcacctcattcggtttagaatggaaaagggaatgagtcccttttcctgtcagtcaagatcgccgagcgtcgctgccatgacagctttaatcgtgtgcatgcggttttcagcttcatcgaacactttagagtgtttgctgcggaacacttcgtccgtcacttccatttctttaaggccgtgctgttcgtaaacattttgtccgtaggttgtatgaaggtcgtggaaggcaggcagacagtgcaggaagatgacgttgtcgttgcctgttttcttgacgagatccatattcacttgataaggcttgagcagtttgattctttctgcaaacttgtcttcttcccccatggatacccagacgtccgtatacagaacgtcggctccggacacggctttatctgtattgcttgtaacggtgatttttccgccggattcttcagcgaacgcttccgccattttaacgatgtcctgatcagggaaaagctcttgaggcgaacagattcttacgtccatgccgacttttgcgccgccgatgagcaggctgttggcgacattgttccggccgtcgccgatataggtgagcttgacgccttttacgcgtcccgtatgttctttcacagtcataaagtccgcaagcatctgcgtcggatgccataaatcggtcagcccgttccataccggcacaccggaatgctctgccagtgagatcactttttcgtgttcaaatccgcggaattcaattccgtcgaacatgcggccgagaactttggccgtgtcttcgatcgactcttttttgccgagctgaatgtcgtctttgcccaaatattcgggatgcgcaccgaggtcgatacaggctgtcgtaaaagcgcagcgcgttcttgtagaaggcttttcaaacagcaaagcgatgtttttgccttccaaatagcgatgcctgatgccttgtgcttttttttcttttagtttctgggccagatcgagcaaatagaggatttcttcttctgaaaaatctttttcagctaagtagcttctgccttttaaattaatcgtttggttcatggatctctctcctttttctttaggttggttatttcacatcttctcggtagagcggcatgctcatgcagcgcgggccgccgcgtcctcttgaaagctccccgctcgggatttcgattaccttaatgccctgttctctcaaacattcgttagaaatgtaattccggtcataggtgacgacaacccccggagcgatcgcgagtgtattggagccgtcattccattgctccctggctgaagcaatttcgtctccgccgccgcagaagatcaagttgacatctgaaaggccgagcgttctcttcagcacttccggcaaattgtgttcttcagttgtatgaatctcgtctgccgtttttcctctttcaagaacgaagatccgcatgtctccttcaggcccctggatggcgggatggatcgtgaattgatctcggtcaaccatcgtgaagacggtatctaaatgcataaaggctctgctctttggtatttcgacggccagtacacggcgaatccggctctgccgctgaaacaagttccggacaagacgctcgatcgcctgagccgttgtccgttccgataccccgatcgcaacggtttcttcatttaagacaagctcatctccgccttcgatattgaatttgaaatcacggtcgagccaaaccggaatctcgtgtcctttaaaacgcgggtggtgattgataatgtagcgcataaacagcgattcccttcggcgggcaggctccttcattttgttgatggtcagtccgctgccgatggcggccgccggatctcttgtgaaataaaggttcggcatcggatcgagataaaatggataatggtcttccatcagctcatgaagatgcgattttttttcgcgttcaagctcattttttcgaatgccgctcatcacctgttcaaccattgaatcggcgtcaaaggtaagcaaaaactctttcagcctgtcgtatgcgccgttgatatccgctttgctttccgttaaaagctcatcgataaactgctcgcggactaatgcgtcatccaaagcttcggccgtcagcttttctaaataaagaacttcagccccctgttgctttaatgtttctgcaaattggtcatgctctttttgcaccgctggcaaaaagggaatatcgtcaaagagaagcctttccagatattcgggtgtgaggttttccagttcccgaccgggccgcttcagcataacggtttttaaagggccgatttctgagtaaacgtgtatcggtgttgtcatgatcatcccgcctcctaagctctttttgttacatgtacagcttaaaacaggaaggagaagcgcgatgtgaaagcgataacaacaaaaacgtgatatatttcacatgttttttgatgaagcaaaaacaaaaatgaataattatgataaatggaaaataagttcctgtcggagcggagaatagaacgtataaaacgtgtatatttttaacggggatttctcgaaaaaaatttttttgaagggcaaaaaaagctgatccggacggccggatcagcataaatggtcataaaatgattgggctgcctcaggtgactgggaaatcacaaggcatgtatcgttcccgcatatacagcccagcatttccgggcttccgagcttatcaagaagaacgccgatggcatgggcgttgccgggcattgttttaataatgatcaagttgtccgttcgatgcacatgcaggacaacgtcagagattttatcttttaatattttggaaggattgatggataaagaagcatttgtcgtgtagacaagttttccgttttcaccgggctgtttcacaagatacatttctttaatatcgcgggaaatggtagactgcgaaacggtgatgccgcgtttttccagcagggatgccagctgttcctgattttctaccggatgttcgagaatggtctgcttgatgagccattgccgtttttgtttgttcataagagcgcctcccaggcaaaacacgtatatctattattatagaatggttttatcgctgacagatggaagctattttacaaaaaaacaaatctttcaggctgatataggggttgatagaccccagaatttcacttataatgcttgaagatgacaaattgatagcagagaaaaggtggttttctagggttccgcagtgccctcccgcgctggtctggtccgagagaaaacacatagcgaagtatcgttatgacacggtgggataaaagcccaggagtttttgctcttaatcaaagagcttctctcctgggcttttttactttttacaggaaatcgattaaggataaagaaaggggatgtatttatgaaaaagaaagcaatggacataatattgatcattataggcgcatttttctttgcgttagccgtgaatctgttcgccatcccgaatgacttgggagaaggcggcgtcacggggatcacgctgattttatactacgtttttgaatggtctccgggcatcacaaactttgtactgaacggcattcttctgattatcggctatcgctttttggataaaaagacgacgatttacactattattgcggtggcggccaattcgttctttctgcacgtcaccgaagattggacggtgccggccgatgaagtgatcatcagcaccatctttgccggggtatttgccggcgtcggaatcggcatgatcatccgtgtcggcggaaccaccgccgggtctgcgattctcgcgagaatcgccaataaatattttgactggaacatcagctatgccttgctgatgatcgatttagttgtcgtcttcagttcctactttatcattggagctgaaaagctgatgtttacgattgtcatgctgtacatcgccacgaaggtcatggacttcattatcgaagggctcaacacgaaaaaggcgatcacgattatttccgagcataaaaacgagatcgcggcgcaggtcaataccctgatggaccgcggcgtcacgatattatcgggacgcgggcactatacgggcgactccaaagaaattttatacattgtcattaataaacaagagctgtccatgctgaagaaaattattagaagcacagataaaaaagcatttgtcatcatccacgatgtcagggatgtattcggcgagggatttgttgatatttcaaaataggggaaggctgccggcagatggccgggagccttttctgtattcattctgattagggacagacaaatacatgaagttttatgcaggaactggtttctgtggtaaggtaggtcttggcatgaatattatttgtagcggaatccgcttgctgaagtagaggagggcctaattatttttggaacaggaaaaaaagcagacatttgatgtgaaaagcagaatgtcctttagagtatgggtttttgcagggactgcaggtttcggattgattggagcatggctcttttatgaagcaataaaactcgaatcaaaatattccttgctgtacgtgggcgttggaactttcgggatcatctacggtttgatgacctttctaatggtttttccggccttcacgaaaaaaggaaacatcatcttcaccattatcgagggagaagacgggcggatattctcagggaagaaatctgtgttgttcaaggacatcaaaagccttaaaatggcggagcaccgctacagcccgaaaggcattttcttgatggatatactgatagagacacgggggaacggcagggtgcggattccgacgtacaacattctgcctgagccggaattttataaagcggtcgagctgtacatcctgccgtatatgacggaggaagcgcgtgcggaatggatcggtcagtttacagaagcgcaaagaaaggcttatttaaatgaatttcataaagatatttaatcgtccgggaaactgcaattttctagatgaaagaaaataactgaaacctttggggaaattcattcgtcttaattaaaggccgttgtcttacatgcggaaaatttttttcgcaggcgtagactgtttgagtgagggaagccgggggatttcaccaggacgtgcttgtaaaaccgccgagacttttagtagaatgatatattatcgtttcctcacgcttcattgactgaaacagaaagcggtctgaaaaaagtttaaaaaggtagaggttatcatgaaaaaaatattctctcataagctaagcttttttgtattagctgttgtttttgtatgggctaaaacctatgcttcctactttttagagtttaatttaggtgtgaaagggtctacgcagcacatgctgctgttcatcaacccattgagcttcacgattgctgcactcggtttggctttgtttgcaaaaggccgccggtcggcgatatggatcatcatcattgatgctgtgatgacgtttgctttatatgcaaatgtcctgttttaccgtttctttgatgactttttgacgtttgcaaacttaaaacaagccggaaacctcggcaatatgtctgacggcgtttttgacatcatggcatttcatgacatcgtctatttcgcagatttgatcattttgattgctctatgtgtgaagctgcctgaactgaaggccgcacagctgaaaaaaagatgggctgctgccgttgttctcggcggagtggctctgtttttcatcaaccttgcagttgccgagacagaccgtccggagcttttgacaagaacatttgaccgaaattacatcgtcaagtatttggggccttacaattacatgatctatgatggtgttcaggccgctcaaaacgcgagccaaaaggcatacgcgagcagcgacgacctgacgagcgtcatcaactatacaaattcgcattatgcgaaaccgaatgacgagtatttcggcgcagcaaaaggtaagaacatcatcaagattcatttggaaagcttccagacgtttttgatcgattataagctgaacggaaaagaagtcacgccgttcttgaacaagctggcgcacggccaggatgacatgatgtatttcgataactttttccatcagaccggccaaggtaaaacagcggatgccgaattgatgatggacaacagcctttacggacttcctgaaggcagtgcgtttgtaacaaaagggcaaaatacgtaccagtccctgccggcgattctgaaccaaaaagaaggctacacaagcgccgtgctgcacggggactacaagtcattctggaaccgcgaccaggtgtataaacaaattggctatgacaaattctttgacgccagcacatatgatatgtcagaggataatctcgtcaaccttggcttgaaagacaagccgttctttgaagaatcaattccgaagctgaaatcgctcaagcagccgttctatgcgcatttaatctcgttgacaaaccactatccgttcattttggatgaagaggatgccacccttgaaaagggaacaacgggagacaaaacggtagacggttacttccagacggcgcgctatcttgacgaagcgcttgaagatttctttaaagagctgaaaaaagcgggattatttgatgattctgttatagtgatctatggtgaccacaacggaatctcagagaatcacaaccgtgcgatgaaagaagtattaggtaaagagattacaccgtatcaaaacgcgatgaatcagcgcgtaccgcttatgatccgcattccgggcaaaaaaggcggagtcaaccatacgtatggcggtgaaatggatgtcatgccgacacttcttcacctgcaaggtattgacagcaaaaaatacatcaactttggtacagacctcttttctaaagaccacgaccaaaccgtggctttcagaaatggaaactatgtaacgccgaagtacacgatgattgatacgaccgtatatgatacaaagacaggaaaagagatcaagggcaaccaagagacggaaaacctgaaatcgcaggtgtccgaacagctggatctgtccgaccaagtactctataaagatctgttgagattccacgagatttcagacttcaagcctgttgatccatcaaaatatcattacggaaaagaaaaaaccggagaataaaagacaaaaaaccgcctgactgctttaacaagcgtcaggcggtttttttgtggggccgctccgccgttgttctaagaagcctgtccggcacatagattgataggaaagaagacagaacaatgaaagaggatgtgagagcgttgaccaaatctcagtatttctttaaattgcatcctttgatggtgccggccggctggaaggtgaaggaaaatcatttgtatcaaaagccgattcgcgacccccgccatacgctattgatcttggagaatgaaagctgcggtaaaatggtacaagttgaatatgctggagaactgaagtacgtcatcaggatgcaaaatgctgatcaatcgaaggtcagcgaagattctgacgcgccgtatgaacagctgatcgaacggttggaagacttgatgcgtgcctctgatggcgcccgcaatttgctaaggcttagaatcccggccggctggacagttgcgcatcactctttaactgatacaaaccccgatgaactagcgcctgacagcaaggcttggctgtttgacttcaaacgggaccttttgaagctgcggcatgatgaagaacgccttctgctcgatgtagagtggtatcccgagtgcagtccggcaggccattatgcgctgaaattgataaagaacgggaactgggacagccctttggaagacatgctgtgcatccatccgaaggaattagcgtatgagattaacgctgttttgaaaaagacttgcgaacatcaatatgtggatgaaaccggcgcataacggccggtttttgtgcgaagagacgctttttcgattcatacttttcattcaataaaattccatatttttcttgatcgaataagaaaaatattttatcatggtaaaagatacataacaaatagacgaaaggggtcaaatgggatgaaaaaaatagcagcgggtcttttgtctgccggtctgatcatcggtttttcctggggcgccggcgatgtggcagaagcaaaaacgaaggtaaagacgtacaaaaactgcaaagctttaaacaaagactataaaggcggcgtcgcccgtacgaaatcggtgaaaaacaaaggcggaaaaacgaagtacaagccgtatgtttcaaaagcgctttatgatgccaataagaagctggaccgcgataaagacaaaattgcctgtgagcgctgatatatccaaaaaaagatctctgccaagggatctttttttgtttatcaggaaatttatgaaaattaaagactgctgaaacataatcttaacagtgcgaacctatactttggcaagagaagagcaaaaggggagtggatgatgtgtcagctttattcaaaaaattgatgttatcttcattgatcggggtttccatcgggtcagcgctgtttgcaccgaatgcgggtgcacaagagccggcggtgaagcctaaaaaagtggatgtcattgcacacagaggcgcttcgggatatgcgccggaaaacacgatggctgcttttgataaagcgcttcagatgaaagcagattatatcgagctggatgttcaaatgtccaaagacggggagcttgtcatcattcacgatacgaccgtaaaccgtacgacagatattgactcagtgctgccggttgccgtaaaggatttgacgcttgccgagctgcgcaagcttgatgccggcagcttcttcggtccgcagttcgcaggagagcgcattccgacatttgaagaagtgcttgaccggtataaagggaagatcggaatgctgatcgaattgaaagagcctgcacgctatccgggaatcgaaggaaaagtgtcagcagcattgaaagagcggagaatggataagcctaaaaacggaaaaatcattgtacaatcgtttgattttaactctgtctataaaattcatcagctgcttccatcgatgccgacaggtgtcttgacgtcaaaagcggcggacttaacagatgcaaagcttaaggaattttccggctatgccaaatacgtgaacgccaacttgaaaaatgtggccgctgatcctacgcttgtgccgagaattcatgcgctcggcatgaagattacgccttggaccgtccgctcccgcgatgaagtgcctccgctattaaaggccggcgtggacgggattgtgacagactttcccgactatgttccgaaaaaagtacggtagccacaataagaaagcctgcagctcgctctgcaggctttttcattcatcaataaaactgggctagcagcagcagcgtcagcgtaacggttatcgctccgccgattcttgtggacacctgggcaaacggcataagctcgaggcgctctgcggcgctgagaattgcgatgtcgccggtgcctccctggccggaatggcaagcattgatgatcgcggtttcgatcgggtacatattcagccacttccctgcaaaaaagccgacggctatcatcgtgaccacgacggatacgatcgtaataatattggcgatattaaaagctgcgatcagcttgtcccacggtgtcatggagacgccaatggcaaaaagcagcggatatgtcacagcagttgaaaagaagcgcgacacgccgtaggcgccgttttccaaattcgccggagccagacgaaacagtttcacggcaacagccagcagaagcatcatgacgggtgctggaaatccgaacaagtcatgtgaaagcataccgaccaaatataatgagacggcgagaatgcctcctgacgcaaagtgggaaagattaaaaacgctttctttgtctttgtcgcggctttcgagcggctgtgcgtccccgctatcaaaacggtcaacttttccgttgcctgtcaattcaggctttttcttcccgattacatttaaaattccggacaaaatgacggcgcttaagcttccgaacattatggaaggaatgacaagtgcaaaagcttccccttgtgacatgtgcatgatttccgaatagccgatggacagcggaatagctccctcgccaacccctccggccatgatcggaattacaatgtacagcagcgtatgctgaaatccgaggccgagcattgtaccgaccgccagaccgactgccgctgcagcaatggtccctgcaatcagaggaataaaaattttaatgaacgccctgaccagcgtttctcttttcattcctaaaatgcttccgactacaatggcagagatgaacaaataaagaaagtttgagatttctgtaaattcagttgttgatttgataatgtcatcgggaatgagatggtaatagacgatagctgaaggaataaacgtcgcaagtatagcggcaccgccgacagaacgaagaagcggcagcgactttccgatttgggcgaaggtgaatccgaaaaagcccgtaaccgcaatggctgttaaaatgtcgcttttcagatcgtgcatatagacaaacgtcacaatcaaagcgaagagcagcaaatatacgggcagcggaatgatgccgattttaacattcattgctcttgcaaaaaaattttcatcctgttcttttgttgtttgaatcggtatatgttgtacctttgtttttgcttccatattctttcccccatcctttatgtgatccccttgctgagttatttaactaaattaagtatactaaaaaaatcaaaattcagacaaccgtgcaggaagacctaactgttttcccataatgatcaaaatttggctaaagacgtgtctggatataggtaatggcccttgtgcaggccgtttttgatgcaattattcctggattccctttttgtggaataaaaatcgacacaaaatagctgttaatccgtcaaaaataaatcaaacatttaggagcagagaccttttttcttttgtaaagcgttgatacattcagctcctttctctgaaaagacacaggacgtctgagacaaaagattcaatcttgatacggggtacatgtgaagggttatcaatgtgagccttatgattttttgaacaagagactatagtcgtataatttcagtttttaatagataaaaagatataatttttataattttttaaagaaaattaggacaaatagtggtaatatatttgagtgcaaaagaaagaaataaaggaatattttagagaaaccctgtaaaaaggtttttttatgtatcacataaggagaagaaaatggaatttattttacactactatcccgcggcaatgattgctctgattctcatcggtttttggggatcgcgggtgaattcgcgttttaagaagtttttaatcatactgtgtcttatgacgaacggtgtgtatattgtatggcggttcggctttacgctgcccgtctctcgccccgccgatatcgtgatgggcgtcatcctgattgcaactgaatgtatcggctttttacagctcttggtcttttatacgctagtatggaaggaaaagaagcgggagccggaaaagctgggcgatcaagaccatcggccgagcgttgatattctcattgcaacttataacgaggagcgccatgtgctgaaaaagtcggtggcaggctgtctgaacctcgactatccaaaagagcttgtcaacatttatttgtgtgatgacggaaggcggacggctattcaaaagctggctgaggaacttggcgttcattacgttacaaggcaaaacaatgagcatgcaaaagcggggaatttaaaccatgcgatgagctgctcaaacggggaactgattgtgacgatggatgccgatatggttccgctcccttcatttttgcagaaaaccgtcggctattttaagaaggaaaaagtggcttttgttcaaacgccgcaggctttctataatgaagatccttatcagtacaacttattttccggagcgaacattccgaatgagcaggactttttcatgcgcaggctccaggctgggaaagaccgttttaatgctgtcatgtacgtcggcagcaatacggttttcagaagaacggctttggaggaaatcggcggttttgcgacaggtgtgattacggaggatatggcaacagggatgcttttgcaaacaaaatttaaatctgttttcgtcaaagaagtgcttgcggtcggtctctcgccggaaacgtggatggatcttttgaaacagcgcgaccgctggtgcaggggaaacattcagtgcggaaagaagtggaatccgcttttcttaaaaggcttgacgcccatgcagcgaatcctttattttgacggcattctcttttggtttttcggcgtttttaagatggtatacatcctcgcgccgctcatgtttttgctgtttggcatacatagcttaaagactgatctgtggtcgatcacttcgttttggctgcctgcgtttttaggttcttacctttcatttaaagccgtttcggaccggcagcgcagtatgaactggagccatatttacgatacatcgatggcgccgcacatggcgatatcggccttgtcggaattcattttcaaaaagcggtttgattttaaagtcacaccgaaaggcgtcaacacagatcggcgaaaattcaaatatacaacggcgctgccgtgtgcgattttgctcgcaatgacgctgcttgcactcggaaaaaccctttatgaattgttgtttcttcatacgtttgatataaacgtcacttcgtataatttattttgggttctctataacatgacagggctcatacttgcgctgctcgttgcctttgacaggccgaggttccgaagctctgagcgtttcacagtcaacaagccggcggctttttccaccgtttcagtagatgagcacaaatgtgaactgatcgatgtgagcgacacgggcgcgcgtatcagactgccttatacggctgattcggatatgtactatcatgtagacggtctgatcatagatgcggtcggaaaagtcccggcccgggtgatgtggacgacgaaggacgaggccgacattgaaatcgggctgcacttcaaagagatggacaaggaactgtatgtgaaactgatcggttttatgtttaatgaagaaaatgcaaaaaaggccgaccgggaaaagcgggctgatacgttgtcaacagtgatacgctttttaacgaaaactgaaaaaagccctgatgcattcaagagaaaatacgtgcgcgaggcctttcaaggtctgggaacactgctgtttccccgtgattcagagaaaggggctcacgaggttatgattaaggatatcagcttgtcaggctgtcagattgaatccggcttcccgcttgaaatcaatgaacatgtgctggtttctatcaatgagaaggacccggatcagcggctggcgctcgtctgctggataaagaagcggagaaagcgatacacagcgggattgaaatttttagatgaacatgcatcaaaatcaatgggagacccggtagcataagctgcgggtctttttttgtcaatggtcttcctgtacggtccgcccgtattcgaatttcatgctttggttcagcatgttttctttagctgtgatctctcggggctgaacaaagaggtgtccgctgtgcacctgagcaaattgtgatctgttccggtacgcagtatgcagtcggacttctttgccagctgctctcaatgaacggccgattggttgcgttggaaaatccgggatatgatggtgtgcgttctgttttccttaaccatggatgtgatattcagccaattggtctggagacggatgggatcaatttgacacagcttgctgcaacacgggcgaaactcgtttatattacgccatcgcatcagtttccgtatggaatggttctgccgatacagaagaggctgaaattgcttgaatgggcaagccgtgagaaggcctatattatcgaagacgactatgacagcgaattccgctatcagggcaggcctattccatctttaaaagcgcttgataaaaaagaaaatgtcatttatttagggactttttcaaagtcatttcttccgggagcgagattgagttatatcgttctgccttcaaaactggcggatgaatttcaagagaagcttggccgctacagccagtctgcttcacccatcattcaaaaagcgatgtttttatttatgaaagaagggtttttcgaaaggcacatccgtaaaatgaaaaaagtatatcaagaaaagcacaaaacattaatatcggccattaaaacgcatttcggaaatgacgtggaaatcatcggcgaaaaagcggggctccatattttgatgaagacagaccgacatgcacaagacctcatacataaagcggaaaaactcggtgtgaaagtttatccggtatccgatttctggattaagcctcatgaaagcagctcttcaatcgtcatggcgggatttgggggtcttactgcagcggaaattgaagaagggatcagcagactgcgtaaagcttggctctcctcctcaaagcaggaacagtgaaaaatgcccgttccgcaccgatattaaaaaggattcagtagatagaaagcgggaataattgtgaaaaaaacgaaaatgttacttgtgctgtctatgttgatgggggtgctgtacgggtgttccggtcatgaaacaaaaggagaggaaaaaacagaaccaaatacggctcaaaaagcggcaaaacaatcaaaacagcaggcggaacatgatccatcatccaagtgggtcaaagtgaaaagcccggcccgcattccgattctcatgtatcacagcatttcctcaggaaacagcctgcgcgtaccggaaggggaattccgcgggcatatgaaatggctgaaggataacggctattacacgttgacacctgaggaagcctatattgtcttaacgcaagataaaatgccgagtgataaatgcgtgctgattacgtttgatgacggttatacagataactttgaaaaagcgtacccgattttgaaaggctatgggatgaaggcgacaatttttatgatcggcaaatcggttggcgggaagaaccatttgacggagaaacaaatgaatgaaatgaggcgaaacggcatttcgattcaaagccataccattcatcacgttgaattgaacggactggcaccgggacagcagctcgatgaaatgacgcgttccaaagcgctgtttgatcgcatgttcagccaaaatacggtgatgctgagctatccggtcgggcgctacaacgaagatacgctgaaactcgcaaagcaggcaggctatcaaatggccgtcacaacagaaccgggagcggcatctagggatcaggggatgtatgcgctccaccgcgtccgaatctcgccggggatgtcgccggacgcctttgggaaaatggtggaacacagcagacaataggaaagacggcatttatcatgatgccgctttccttattttttttcgttttggtgcgtcgggctcatgacaagccgcagattcgggcgcataccttcggaggttcggcggtttgccgtctgtccgggagcggtttcgattaccctcaaaactccggtcggcgcagctgcctggcggatcaatattctgcttttcggtgccgcttttttataagaacttttgttgttcttgtcaaaaaagaatgaatacaaaataaacagagccaataaaaccagtaaaaaaatcatctggaaaaaaccctccttatcatgaatgtcttcttttaatatcgaacaagtaggtgcaaagttttatatgttttgtatcagaatcgctttattgtgacttttaaatcgtttgaagagcgggaatctgctgtctttacatcattcccaatcggaagtcaggttaaacaactgaatgaataatgacgtatttggagttgatgttgaatgaatgatgaagggagatagctggaatatacccggctcactgcagcaagaactgcatacagcctagggatccgagcaggagcagaagttaggttaacgcagccgcaggtcttaacagccgccatcgccgccgcaatcacccccgctgtctccggatgagtcaggacctccaataaaaaaagtcgaagagctgctgccgctgtttttttccccggacggcaacatggaggcgtagagaaggaaaaccaccagtataaaaccaattattccaacaatcatatgaaaacctcctaaacaatatgacttctgtttttatacgagcaacgggccaaaaagtttcggaattttgttaaaatatagtgattcatagaaaaaacggcttagacgccgttttttattgcttgatcaattttttctgaacggcactcggcatgccgccgggctgtacttcttcccatgtctcaacatattttcccttcgcgtttacctttagataggcgtttcttcgaagggaatcgctggcggagaatgtaatttctttttccttaccggtgtcattatatccttccagcgtgtactcatagcggcccgggctcaggtgcttaccgtctttgttgatctggacatatacgctttctttcttcacaagtggattgaacctgtctgtcacttcattatgaatcaacagaaatgcgccgatacatacagctaaagcggctgtaatgagagaaattgtttttttcatattttatcaccttaaaaatccttttaattttttcagatagctttttcgaatcatcataaagaataatagttggaagatcagaaatccgcctattgtcatgatcaccggagatgcgaaatgaccaaggctctgtgcctcgagcgtcttcatcgcaaaatacgtatgaattgaggcgagtacgaacggaaagaagaacaggatggccaattgaatcgttacgctctgcgacatttccttttcgctcaggccgatttttgagagtgaccggtagcgctcttgatcttcttcaagatcggtaaacaggcggaagtacagaaagctcccggatgccgtaaaaaagagaaccgcaataaagaatccgataaacagactcaggcttggaagctgaacagtttcaaaataattgatggcctttgcttcaaattgaaattggatattgtgagatttttctctgagatctttttccaatgattggctcatgtcgaggctctctttccagcggttgtactgatagccgtacaatgtgagggattcgccttgttttttcagcttttcgaaggttttgccgtttacgacaacgatgctttctaacgaaatgagcggttttttaataccttttacctttagccgttcatttgccggcttcaaatctttgttcaacatgtccaaggtctcaggaatttcccgcttttcttttgcctcaaaggcgtttggataatacagcgcctcaccgtctttcagttcaccggaatttaacttgaagtgcttttggaattcgccttcagagaccaggagcaccggaggaaggagatctccctggctatagctcatataaattccttttgtcacttcctttgcatacgaaaaatgtccgtccttcaatttttgttcgatcaccttaacgtgtgtttgttccttttggctcccgctgtataataagtactctatctcatatcgggaatccaattttccgatagaagtcttggaaattaccaatgcacccatggcggtaaaggcgaccgcggaaatgatgcaaacgagaaagaacaggcgggcattatccttcagccgataaacaagatcggatatccaaagcacgttttttcctcgtaaataaaatgacctccgcttttttaacagccgcagcagccaaatgctgctttggctgaagaagaaataagtcccgatgatcgtcaaaattaagatcgtgacggcttggggaaaatggatgtcggcgaacaatacaagccagtagccggagccgaggcagccgatgccgacgaccgaaaaaataatggacggttttggctccggtttaattttcccggtgcctttgatcagcttgacaacggtttttgatttaataaataacaccgtaaattgcgacagcagaataaacagcgcaagaaagcaggcggatgtaagggccatcgctttccaaggcagatacaatggcaaagcgtccatttccagaatataagcgccgatcgtaaagaatgtttttgcaaaaacaagaccgccgatgatgcctgtaacgatcgaaagcacgccgatgatgatgttttctgcggtaatcagcttcctcaattgacccggagcgattccctggatggtgaggatcccgaattccttgcttctcgacttgagaaaggcgttgacggaataaagcacaaacagaatggaaaaggcgaaaatcatccattcagccaccgacaacccccgttttgcaatggtgtttaagtagccttcctctaaagcggggtggaacaaaaacatcgcaaatgtgaaaaaaatcatcactgaaaatgagctgcttaaaaagaaggcgagataggctcttttattccggacgacgtttttataagcgaactgaagaaaggtcattggtatttcctcccagcatagacagcacattcagaatctcttcataaaatacttggcggttggcgccgcggtaaatttcattgaataatgttccgtctttaataaaaatgacgcgacggcaatagcttgcggcaactgggtcgtgcgtgaccattaatatcgtggcattgtcgttttcattaagatgctgcatcgtctccatcacgtcttttgatgcctgcgaatcgaggtttcctgtcggttcgtcggcgaggatgagggcgggctgatgaatgacggctcttgcgatggccgcccgctgcttttgtccgccggatacttcaaacgtccgtttgttcaaaagttgttcaatgccgagtttttcagcaatcgcctgaagtttatcttccatgacggaaagcggttgattttcaagcgttaacggcagcatgatgttttcgccgatcgtcagtgtatccagcaaattaaaatcctggaatacgaacccgagctgcctgcggcgaaagtgggcaagcttcgccctttttaaatgatgcgggtcttctccgcgaattaaaatgtcgccggaatccgggcggtcaatcgtcgaaatgatattgagaagcgtcgtttttccagaaccggacggccccatgatcgccgtgaactcactttcctcgacattgaatgaaatatcttttaaagcctgatgggagacttgtcctttatatgttttattgatgtttttaacgaccagcatatttgttgtcatgatatcctacttttgctgcgctttttaaggatgaccgtttccggtatgttatccattccagcgggctcctccggaatgctttcagccaaaatgcgtttatgaaaggcttgaatggccattgtccagaaactaagaacggcggcctcgtttatataacagaatgtgccgactcttttcatagactcggattgcttataaaaaatcctccttgccacgtttgttttgtaaacaaatcatatcaaggaggatggggatgagctatgcggttttattaaagaagacttacatttttgtaagaaatgaaaattgcacagtcgtttcttttccttcttctgaatcgatgctcacatcatgattgagcttttcggcaatctcttttacaaggtagaggccgatgcctgttgattcctgaaagcgccgtccgttttccccggtgtaataaggctcaaatacgcgtttcacatcttgtgaagggattccgattccgtaatctttgatttccagaatgatgcgttcgcctttacggaatatcgtcaaatcgatgcgttcgcttcttcctgacgagtacttcacagcgttagtgatgacttggccagtggaaaatctgagccatttgcgatcggagtaaataacggcgtcttcagcgggaacctgtttatttggatagacacgatgctgtataaaatagcgtttatagcgctgaatcagcgaattaagcagctcgtctagtgacacggcctcaattttaaaatctctttcaaacaggtcaagccttgatgaatagaggagcgtctccagtccgtattcaatctgctggacttcttttttgatttgtttaaaaacgggttcgtcctcttcctggatgatcagattgatgacggaaagcggtgttttcacctgatgcacccattgattcatgtaggttaccctatcttccagcttggactccatatcatgtattttgcggtggtggagccggctcagctccatatgtttttcatagagctctgagcaaaattcagacgtccccaaaaaaggaatttctgtatctttttgatctgagccgatccattggtagactctgtgttcttcataccatttgtatgaaagataaagcgcaagcgccagaagctgaacgccgagaatgtaaaaaaggtgggtgaaagtctgcatgccggcaaaccaatagtaaaaaaatacgaatccgccctgaaagagaaacagaaaaatgagaacggcatggttttttaggaacagcttcatgatttcgtcctcagctgatacccttcgccccgcacagattcaattgagaagggcacgtccatgcttcgcagttttttgcgaatccttgtaatatagacatttagcgtgttttcatctacaaatgtatcggtttcccatgtcttctccattaaccggtctctgcttgtcaccttttctcctctttcaagcagcacttccaagagcttgctttccttttttgaaagctcgagcttctcatttcggcagtgcagctcaaaacgttcgacaaacagctggacgccttcaaattcaatcactttttcaccttgttttactgcgtattctccaaatgccctgcgaatttggcctttaattttagcgagcaccacctcataggaaaaaggcttctctatataatcatcgccgccgttttcgatcgccatgacctgatccatttctccgcttctcgccgaaatgaaaatgatcggacaagtcgaatgctggcggatttgcctgcaccagtagtaaccgtcgtatgccggcagattgatgtcaagcaatgccaggtcgggcttctcttggagaaatatttcaaggatagaggtgaaatcagtcgctgcaacagtttcgtatccgtatttttctaaatgatcgcgtaaaagcttccgaatgtcttcgctgtcctcgacaatcatgattttcgtcattttgaacactcctatgaacaagtctccgctgccgatttctttataaaagcggcagtgaagggcctctaatgttaagaatatcataaaaagttttttttcatgtgagcgcttaaggtttttgcataccagatcatgataattcagtttctctgagttaaaataggaatggacgactgtcaaaaaaggagaggatcaaatggcgaaatacagaggttatatcggaacatatacaaaagcagacagcgtagggatttatacatttgagcttgatacggaaaaaaaggcgttaagcacgccgaagccggcagcaaagctgggcagtccgacatatttgaatatcgccaaagacaatgacatgctttatgcagtggtcaaagacggcgataagggcggggttgccgcatatcgtattgacggttccacaggagagctgactatcgtcaaccagcagaccggggaaggaccgtcgccttgccacgtcagtgtggatcaagataaccgttatgttctgtccgccaattaccacaacgggacgatcttggcatatcctttaaatgaaagccgcggcctgcttgagccttcatcaaaagtacagcatgagggatcaggaccgcatgagaggcaggaaaaagcgcatactcattattcaggattctcacctgatgagaaatatgcagtggccgtcgatctcggaacggatcatatcatcacgtatcaattgaaagagggccggcttgaagaagtgaaaaaacacgctgctgcaccgggctcagggccgagacatatcgagttccatccacaggaaaagtatgcgtatgtattaacagagctgagtaatgaagtcatcgtgctggaatacaaccccgatttgggtgaattcagagagattcaagtgatttcggcattgccggaaggctttgacggccatagccaaggcggcgccatccacatcacgaaagacggcaaatttgtatacgcttcaaaccgcggccacgacagcatcgccgtcttcagcgtcaacgagtattcgggcgaactttccctggttgaacacgtatcaactgaaggggaatggccgcgcgactttgagattgatccttcagagcaattcttagttgcttccaaccaggaaacagggactttgacattgtttgaaagagaccggacaacgggccggctgacgcttttagagtctggagttcctgctcctgaagcggtttgtgtgaaatttttacatcaataaaagcaaaaaaaacttgattggcctttttagccagtcaagttttttctttttatagcatgcggcggttaaccgctgtcattttactccgcatccagcccttttttgaccttgataaacgcaaccatctgcttgatttcttcttcggaaagaagcgttccgtcgactgccagcttgagcttagcccaatccgtcagttcaatggcttcgtttttagccttttcatcccggggatcgtcaactcttccgagcaaaaaatcggtggaggtattgaataaatcagcgatttcgataagcgcctctaaagaagggcggcggtatcccgattcatagcccgcgtaagtgcttttcgcaataccgaggcggtcggcagtatattgcaatgaccattttttgttttttctcagtgttgttaatcgatctaaattcatatcttacgctccttttgatacacagtgattatagcacattatcagtaaaagtgtacgcgaaatgaataaagtttcttgattatttcacatttgaggactataattgcattgaaggtacgcataaagcgtatacattcctgatgtatcaagccttctttgctaaaataaatcatgatttatactgtataaaactacttcttaaagaggtgtagcacatgaaaaagttactgctgttgaccaccggcgggaccatcgcttcagtagaaggcgaaaacggactggctccgggggttaaagcggaagagcttctcagctatttatctgatgatcattcaaattatacgatagattgccaatctttaatggatatagacagcaccaacatgcagcctgaacactgggtgatgatggctgaggctgtatatgaaaattacagccgctacgacggctttgtgatcacgcacggaaccgatacgatggcctacacctcagcggcgctttcatacatgctgcagaatattgataagcccgtcgcgattacgggttcccaagttccgattacgtttaagaaaacggatgcgaaaaaaaatataaaagatgcggtccgctttgcgtgcgacggcatcggcggagtatatgtcgtctttgacggccgcgtcattttaggcacgagagcgatcaaattaagaacaaaaagctacgatgcatttgaaagcatcaattatccttacatcgctttcattcacgataaggaaatcgagtacaacaaacgggttcccgaagtaaagccaggcgctttgaaactcgatacctctttaaataccgacgtttgtctggtgaagcttcatccgggtttaaaaccagagtttttcgattgtctgaaaggttcatataaaggcattgtgattgagagctacggaagcggcggcattccttttgagaaaagaaacattttagaaaaagtgaacgagctgatcgattccggtatggtcgtagcgatcacgacgcaatgccttgaagaaggagaggatatgagcatttacgaggtcggccgcaaggtaaaccaggatgccattatccgctcgagaaatatgaacactgaagcgatcgttccgaagctgatgtgggctttagggaaaaacggacaacaagctgaagtcaaaaagatcatggaaacgccgattgcagacgatattatcatataaaaagaaagcagggttaaaaaatgaaagctgaaatgacataccggacggaaaaggattttctcggagagaagaagattccggccgatgtctactacgggattcagacattgcgggcagcggagaacttcccgattacaggatataaaatccacgaagaaatgatcaaggcgctggcagtggtgaaaaaagcggcggcgcttgccaacatggagacaaaacgtctttataaaggccttggagatgccatcgtccaagccgctgatgagatccttgaaggaaagctgcacgatcagttcatcgttgatccgatccaaggcggcgcaggcacttcaatgaatatgaacgcgaacgaagtcatcggaaaccgcgcacttgaactgctcggccacaacaaaggcgaatatattcacctgagtccgaatacgcacgtcaacatgtctcaatcgacaaacgacgtattcccgacggcgattcatatttcaacgcttaagctgctggaaaagctgctggacacaatggaatacatgcttgatgcctttaagaaaaaagcacgcgactttgaccacgtcattaaaatggggcgcacccatcttcaagacgccgtgccgatccgccttggacaggagtttgaagcctacagccgcgtgatcgaacgcgacatcaaacggattaaacaatcgcgccagcatttgtatgaagtcaatatgggcgctaccgcggttggaacgggattaaacgcggatccgcgctatatcgaaaatgtcgtcaagcacttggctgagatcagcggtcttccgcttgtcggcgctgaccatctggtagatgcgacgcaaaatacggacgcttacacagaagtttcagctgcattaaaagtatgcatgatgaacatgtcgaaaatcgccaacgaccttcggttgatggcatcaggtccgcgcgcaggacttgcggagatttcccttccggcaagacagccgggttcatccattatgccggggaaagtcaatccggttatggccgagctgatcaaccaaatcgccttccaggtcatcggaaacgatcatacgatctgccttgcttctgaagccggacagctcgaactgaatgtgatggagccagtgctcgtctttaatctcctgcaatccatcagcatcatgaacaacggattccgttcgttcactgatcactgtgtagcaggtattgaagcgaatgaaaaacgcttaaaagcatatgttgaaaagagcgccggcgtcatcactgcggtcaatccgcatcttggctacgaagcagctgcaaggattgcgagagaagccattttaacaggccaatccgtccgcgatctctgtcttcaaaacgatgtgttgacagaagaagagcttgatctgattttgaatccttatgaaatgacaaaaccggggattgccggggctgaacttttaaatcgggattgatctggaaaaaacagtatgcgaaaacactctgacattttaccgggatagaaacacagagtgttttcgctttccttcaataactttatgaagagaaaggacaacagcggtgaagtggtaccgcatcagcctttttcatggtatactgttcgttgttagttaaatttttaagaaaaaattgaagcagattgctatttttatgtagtttattttgaaagcgtttcaataattaagggggatttaggttgaaaacagcacggttgccatcaatgttggaaatcatttgtgtattaggtgcatttttagcgatagtttgttcatttacagtcaaattcgagctgccgattcagctggcattgtttatttcatggttcttggtgattttgctcggactgcgcctggggcaccggtatgaagatttgcaaaaatcgattacaaacggaatttcaaatggacttgaagcgatattgatcctgattgccgtcggcgctcttatcggcacatggatagccggcggtgttgtgccgactttgatttattacgggcttgagtttatccacccgagcatattcctgcttgccacgctcattatttgttcgatcacatctgttgccacaggtacgtcttgggggactgtaggaacggccgggatcgccatgatggcaatcggggaagggctggggcttccgcttccgcttgtagccggagccgtgctgtccggagcctactttggagataaattatcgccgctttccgatagtacggtgcttgcgtcatccctttcaaaggtcgaagtgattacccatgtcagagcgatgctgtacttgtcgattcccgcctatttaatcacggcggtcctgttcaccatcaccggctttatgtatggaagccgaaatgttgatttggaaaaagttgaatttttgaaagcttctttgcagaacacgtttgatattcacatttggatgcttgttccggctgttgtcgtcatcgttctattggcgatgagaaagccatctgtgccgacgatcgcgatcggcgcacttttgggcgcgatctgggctgcggtcttccaaggcatggactttgcggatgcgatcggcacagcatacaacggcttttccattgacaccgggatcaaatttatggacgagctcttaaatcgcggaggaatagagggcatgctcggttcggtcgtcgtcatcattctcggtctgggctttggcggcctcttggagcacttaggcgttctaaaagtgatcgtctccaagttccagcaaaagctgacttctgccggcaacgtcacattctcgacgattatcgtcgccttcttggcaaatgtgttcggctgcgcgatgtatgtctcgctcattttaacaccgaaaattatggaaaaaagctatgacaagctcggaattgaccggagggtgctgtccagaaacgcggaagtcggcggtacgatgacgtcgggcatggtgccgtggtcggacaacggcatatatatggcggggattctcggcgtctcgaccttctcttatgtgccgttcatgtggctgagctttgtttcaatcggccttgcgattttgtacggatacacaggtaaatttatttggtacaccgataaaaaagactcgccggttcagtagccgattttaaaacaattgatggaggtattctgttatgaatggcaacaatattattcggaatttgatgctggaaatcccttcagcacccggaaaccttggaaaggtgacaacggcgatcggccttgccggcggtgatatcggagagattgaaacgatcaaggtagggccgaattatacgatgcggaacattacggttcaagttgagcatgaagaacagctcaccgagattcttgaagtgatccgcaacttaaaagaaggcatccatcttcataccgtttcagatgacgtgctggctgcacatgaaggcggcaaaatccgcatgaaaagcaagatgccgattcgctcgcttgctgatctgcgtcgggtgtatacgccgggtgtcgcgaacgtgtgcgagctcattaaagaagagccgcaaaaagcgaatatttataccggaatcggcaattcggttgcaattgtaacggacggcacggccatccttggcttgggagacatagggccagttgctggaatgcctgttatggaagggaaagccgctcttttcgaccagcttgcggatatcagcggggttccgattctgctcgacacgaatgatcctgatgaaatcgtaaggacggttaaaaacatcgcgcccggctttagcggcattttgcttgaagacatcggttcaccgcattgttttgaaattgaagagcgcctgaaaaacgacctgaatattccggtcatgcatgacgaccagcacggtacggcggttgtgacgctggcggccgccatttcagcagccaagagtgcaggggtggatctgaagcaggcccatgtcggccaaatcggcctgggcgcggcgggtgtcgcgatctgcaggatgtttatggcatatggagtaaaacgtgttgtcggaacggataaatcgcttgaggcgatggcgcgtttagagaactatggcggccatgcggctgaaagcatcgaagaattgatggaaagctgcgatatcgtcgttgcgacaaccggtgttccgggattgatcaataagaaatgggttcgggaaggccaggtgattttggctctgtccaatccgaagccggagattgagcctgaggatgcgctcgaggccggggcagcctacgctgcagacggacggtctgtcaacaatgtgctggggttcccaggtattttcaggggcgtgttaaatgccggagccgattcgatcagccacccgatgctggttgcggccgctgaagcgatcgcatcctgcacaagacaaggcgatcttgtgcctcatccgctgaaccctgaagttcacgagattgtggccaaagcagtcgaaagggtcgcactttcagaaatgggaaaaatcaacggataaagaaaacagctgctgcttcatcgcaatacggataaagcggcagctgtttttttcgcgaatgttaacggcggttctacagattgaaaatgaatatataaaatattcggttctgtaaaaatccaatgattgtggagagcactgataatgatgccctgatcgacaagcttttttgtaaacagcggaacttcttcaggcaaaattgcgacttcggccatattcaaggcgattccgttttaatcgagcgattcgaacatgatttcttccatgccgactccccggctcggtcttccttgaatcgcgacacgcaaattccgtttgatgctgacagaacagacaccgtggttcaatgtgcggctccccatttaaaatatgtccaaattgccggcaaagcgaatgaaaactttgcatcgctgaacctccatttttaaagttaccacgattttatgaagggagcccgcatatttagaatccattaaaaatggacgatctttttatttgatgatttcttcaccgcccggcttgttggcatagtggtacatgaagcccatcataaacgcgcctccgaccaggttcccgagtgttaccggaattaggttatggattgcgcctgcaatcgaaatggtctccggatgctcggtgaccagagagacggcaaaagtggccatgttcgcgatgctgtgttcataaccggaaataaagaaagtaaagacaaacagcatcatagagaacattttcgctccgtcccctttttgcgccatcggaacgaaaaacgcaaggcagacaagccagttacacagaatcgctttaaagaacaattcggtcaccggcgtattcattttatgctccgccacgctgagaataaagccggtggaagaaggatctttaaataagccggtcgcaaagatgaggcctgcgaaaaaaacggcgcccattaaatttcctgcatagctgaacatccacagcttgatcacagtgggccagcgcatttttttacgaagcgcagccaatgtataataaaatgtatttcccgtaaataaatctcctccgccatagacgatcagaataatggcgcccccaaaggtgattgctgcaattggatatgtgaacggagaatgttcaacataaaagagattccccgttttaaacgctacaatgactccgaacccgataaacatactggccagcatagcccgtaaaagatagcgaagcgggctttgcacaaagatgctttgcttttttaaagcaagctcttcgactagaacaagtgatttagattccatgttttccaccaccatcaagtgtttacttaagaagtatctatcataaatacaacctaagtatagcaggatattgtgaaacatttcacaaattttgtgtattttgtttgaacaaatgtatggttcgattttcatagaataaacggggtatcgttattgtttatttcaaagcaataaatattccttcccttcctccgttaatagtcagcgggagctggatggctgtgcagggggaaaaacgtgcggtgcagtcagctcgtgctgcgtgaaggcttcagtggagataaatcagcaaatggatgaagggaatgcgcagaaggcggaaggaagatttcacagattggacaaaacagcagaactttccgtaaggcgcgctcacactgaaggaaaaccccgaatttgtttcactgcatataacggttttcttttgatgcgacaggctttcgcgaagaatcacagatgttgaatgacgaaatgttccacgtgaatttcggggcatttttctcatgttgttttagtgcttgttaaccagcgtgtcacaaaatatctataattccttcgtataattgtcacaatgacatccataaattagggaaaatgtactttatttaagaaggaattcgcggtaaagtacaggtataaataaccatcctgataataacggaacatcaatgcgggccgaggtcacccttttgtctgtaatcataatcacattaataagatgcatgtgaaagtctgagcaagtgtgatgcccatttggcaaacgggcccggctagaacaaagaggaggagacaggaacagtggacgaactcattttggcaagatttcaatttgcttcaacaacgatctttcactttatttttgtaccgatgtcaatcgggcttgtctttatggttgctttaatggaaaccctttatgtcgcaaagaaaaaagacatttacagaacgatggctaaattttgggggcacttatttttaattaattttgcagtcggtgttgtcaccgggattttacaagaatttcagttcggaatgaactggtcggagtactcccgctttgtcggtgatgtattcggcgctccgctcgcggtggaagcgctgctcgctttctttatggaatcgacgtttatcggtttgtggatcttcggctgggaccgccttccgaagaagattcatttgctgtccatttggcttgtttcgcttggcacgatcatgtcggcgttttggattctagcggccaactcgtttatgcaggagcctgtcggatttgcgatcaaaaacggacgcgcggaaatgaccgatttttttgcgattattaaaaacccgcagctatgggttgaatttccgcacgtcattttcggtgcgcttgccactggggcgtttttcattgccggtgtcagcgcgtataaaatgctgaaaaaacaggaattgctcttttttaaaaaatcctttcaaatcgcgatgattgtggcgcttgtttccgggggcggcgttgcgttcagcggacatgagcaggcacagcatctgatgaagagccagccgatgaaaatggctgccagcgaagcgctttgggatgacagcggcgatccggctgcatggacggtgcttgcgaacattgacacggacaagcaggaaaacaaatccgagctcagcatcccgtatgcgctcagctatttggcttataaacaattcagcggcgatgtgcccggaatgaagacactgcaaaagcaatatgaagaaaaatacggagaaggaaattatattccgccggtgaaaacgacattctggagtttcagaatcatggccggatcaggacttttaatgatcgttgccgctttgaccggtctttatctcagcttccgcaaaagactcgaaacaagcaaatggttcttgcggacaatggtggctttgatcgcctttccattcattgcaaatacggcggggtggatcatgactgaaatcggacgccagccgtggacggtgttcggtattttgacaacggcgcagtccgtgtcgccgaacgtatcagcgggaatgctgctgttctctgtcatcgcgtttacagcgatttatcttgtgctggcgctcgttcttgtctacttgtttgtgcgggagattaaaaaaggggctgcacaccatgaccaccatcatgatgattccgtatcgacagacccgtttgatcaggaggtttaccatggtatctcttaatgaattttggtttatattagtcgctgtgctgttcatcggttttttctttcttgagggctttgatttcggcgtcggaatggcgacgcggtttctcgggcgcaacgatcttgaacggagggtgatgatcaatacgatcggtcctttctgggatgcaaatgaagtctggctgctgaccgggggaggcgcgattttcgccgcttttccgaactggtatgccacgatgttcagcggatattacattccgtttgtctttgttcttcttgcattgatcggccgcggggtcgcgtttgaatttagaggaaaagtcgaaaccgcaaaatggaagaatacatgggattgggtcgtatttttcggcagcattctgccgccgtttttgttcggtgtattgtttgcgagcatcctgcgcggcatgccgatcgatgccgatatgaatctgcacgccggttttaccgattatgtgaacgtctattccgtgacagggggagtcgccgttacgcttctctgcctgctgcacggcctgatctttattacattgagaacggaagccgatttgcgcgaccgggcaagacagctggccaaaaaagtcgtattcgccgttttggcggcgcttgttgcctttgttgcattatccatttttgaaacggacttgttcacgggcagggggcatgtgacgataccgcttgcggctctgattgtcgtttgctatgtgctgtcgatcgtgtttatgaaacaaaaacgcgacggctggacatttgccatgacgggcgcagggatcgctcttacagtggcgacgattttcactgcgctgttcccgcgcgtcatgatcagctcggtgaaaagcgcatatgacttaaccgtttataatgcttcatcaggcgactattctttaaaggttatgacgatcgtcgcgctggcactgcttccgttcgtgctgggctatcagatctggagctactatgtttttagaaaacgggtcagcagcaaggagccaatgatttattaatgggaaaagatcttttgcaatataaagggatgaaacgaatacttgcagtactcactgtcctgacatgcatgcagggcgccgccattatcatgcaggccgaatggcttgctgaagcggttacccgcctttttaacggagaacgcgtcggttcgctctttccgctgctcatcttatttaccgccgcttttttatttcgacatgctgttacccttgtcaggcaaaagctgatatttgactatgccgccgagacgggggccggcatgcggaaaaagtttttggagaagcttttccaatccggccccaggctggcgaggaaagaaggaaccggtcatgtcgtcacgctcgcgatggaaggaattgcacagttccgccgctatttggagctgtttttgccgaaaatggtcagcatggccgttataccgccggcggttgtctgttatgtcttttttaaagacacatcttccgctgcagtcttaatgattacgatgccgattttaatcgcttttatgatccttcttgggtatgcggctaaaagaaaagcggacagccaatggaaaacgtatgagatgctttcaaaccattttacagattccttgcgcggcctggaaacattgaaagtgctgggcatcagccgttcacatactaagaatatatttcatgtgagcgaacggtacaggaaggcgacgatgagtacgcttaagatcgcctttctgtcatcgtttgcacttgattttttcaccatgctgtccgtagcgaccgttgctgtttttctcggtctcggtcttgttgacggcagcatctcgctggagccggctcttgccattctgattcttgcccctgagttttttctccctgtccgggaagtcggcaatgactatcatgctacattgaacggacgcgaagccggtaaagcgatcaaggcgatattggattcgccgggtttcaaggatgaggcgcctttaagtcttgagcgatggtctgacgacgatcaaatcgagttcaagcatgtagatgtgcggcatgaagatgaggaaaactgctctttatccgggatttctctttcatttaagggaaagagaaaaatcggaatcatcggggaaagcggtgccggaaaatctacgcttatcgatgtgctcggcggcttcctggaaacgaaaagcggcgttatcaaagtcgggggaaaaaagagaacgcatttgcagacggacagctggcaaaatcagctcttgtatattccgcagcatccctatatctttccggatacgctcgcagccaatatccgtttttatcatcccgccgcttctgacgaagacgttgaacaggcagcaagagctgccgggctctcggagctgattgatcagcttccaaacggcttgaaagagcggatcggtgaaggcgggagggcattaagcggtggacaggcgcagcgtacagccgttgcccgggctttccttggcaaccgtccgattattcttttagatgagcccactgctcatttggatatcgaaacagaatacgagttgaaaaaaacgatgttaaaactgtttgaagacaagctggtttttttggcaacccatcgccttcactggatgcttgatatggatgaaattatcgtgctgaaagatgggcaggtggctgaaaccggtacacatcaagaactgattgaaaagcggggcgtttattacgagctcgtgaaggcgcagtcgtttggaggtgcatcatgaacaatgaagacgggtggattctgccctacatcaagaaaaatacaaggcttttgatcattgtcgtgctgcttggcgggttgacggcatgctcggcggctgctctcatgtttacctccggttatttaatatccaaagcggctacgcgtccggaaaatgttttgatgatctatgttccgatcgtagcggttcgcaccttcgggattctgcgctcggtgtcgcgctatgttgagcggttgacagggcaccatatcattttgaaaattttatccgatatgcgcgtcaggctttacaggatgctcgaacctcaagctttaaaatggcgtgaacgtttccgaacgggggatatgctcggcattttggccgacgatgttgaacatttgcaggacatgtatttgagaacggtatttcccgggctgtcggctcttcttttatatggcgtattcatcgcagctatcggctttttttcatggccttttgctggactaatggcggtctatgccgcggttttcgtatttcttgttccgcttgtttccctgcttgtgacaagggcaaaaaatgttgcgctgaaaagaggacggagccacttgtaccgtcagctgacagacgcggtcatgggggtgagcgattgggttttcagcggccggcaaaacgactttgtccattcgtatgaagcggcagaacatgaatggctggcgatcgaaaagaaacaggtgcgcttcagtcgttggagggactttgccatgcaatgcctggcggcaggacttgttcttctgatgctaatatgggcgggcggccaaagcgcggaaggggctctggctcctgtgtttattgcggcgtttgtccttgttgtgtttcctttgacggaagctttctttccgctttcggacgcagcggcttcaatccctgagtatcaggattctttagaaagaatggacggtctgcagccgccgaaaagggggaacggggccgatgttcagcaggaacgggcggaggctgtaggtttggacgatgtcacgcttcgctttgaagacgtttctttttcttatgagcaaggccagccggtgttggacggtgtttcatttatattaaagcagggtgaaaagaccgctttgctaggcccgagcggtgcgggtaaatcgaccatcttgtcgttgatacaaggggcgcttgctccttctaaaggaaacattacattgaacgatatttctgtgcagtctcttcagggagaaatttcacgcgtagtctccgttttcaatcagcagccgcacctgtttgatacgacggttttgaataatatccggctcgggaaccctgacgcgagcgatgaggacgtgtattgggcggcgcgccaggtgaagcttcacgattatattcagtctcttcccgatggatatcatacatctgtacaggaaacgggcatccgtttttcaggtggagaacgccagcggattgctttggcgcggattctgctgcaggacgcacccatcgtcgtgttggacgaaccgaccgtaggccttgatcctaaaacagagaaggagcttctttcaacgatgtttcaagtacttgatggaaagaccgttctatggattacacaccatttggcaggagccgaagcggccgaccggattctgtttttagacaaagggaagcttgcaatggcagggagccatcagcagcttttggaaaacaatccgcgctattcaagactttatcgtctggatgcgcctgtcagccggcttttttagtcgaaaacgccaagcacagcttcaagttgtgaagctgtcttttttatatgaacgtaaactgatccgttcatcagtgctattttgcatgttaaagagcagtgaagggtatgattcagttacaatttaattaaacgtttgtttaaactatattgaaaggtgtgatccgggatgtctgcagaacaattgccgatatggacgaaagactgcgtgaagggctcattgccgaaaaggggaaatgatagtcataaaggaacttatggaaccggccttttgctcgcgggaagcgatgatatgccgggagcggctctccttgcaggaatcggggcgatgcggagcggtctaggaaagcttgtcatcggaacgtgcgggagtgcgattccgctgatcctccccgttcttcctgaggcgacgtattggcgggacggcgccgaaaaggcggcgtcaggcgagattgccgaaccttaccgggcgattgcgatcgggcctgggctgccgccttcgcaaatgactgagcaagcggttcaaagcgtattagcgaaagactgcccggttgtgcttgatgcgggtgctctttcaaaacgatcgtatcatgaacgggaagcgccggtggtattaacgccgcatccgggcgaattttcgaaaatgacaggcttgtccattcgagaaattgaagcaaaccgggccggttatgctcgagattatgcggaggaacaaggtattacccttgtcttgaaaggcaatgaaacgatcgttgctttccccgacggcgagtgctggaggaatgtaacgggaaatggggcgctggcaaagggaggaacgggggatacgttaacaggtatgcttctcgggatgctgtgctgtcatgagaattcgagagaagcggtgctgaatgctgtccacttgcacggcgcatgtgcggacgcatggacaaagaccagatcggctcatgcgcttcttgcgcatgaactttccgatctgctgccaacggtatggaaagcgtatgaggatggaaataagtgaaacgcccggaatgccccggacgtttcacctcaaagcttatggattgattttgccgactccggcattttgcttgacgattgattttacattgtcgacattgtcgagtgagtagctgtatggcggattataggttgtagtagaggtagtcggcatactgcccctagagtttacaaatttgttgttggatacatgccaatagcccggtgaactgctgtaccaagagacaatcggatctttggcgttttcaaagaggttgttctcaattctgatgcgcgcgcccatcctcgaattaattccgctgtcgatgattttattgaaatagttgttgtaaatatggccttctccgaaacggaatgacggcacacgcgaattcagattctcaaaccagttatgatggaatgtaatcgtcctgttgtaattatcgctgtccgatgaacccatcagcattgatttccatccatcgtgcacatagttccaagagaatgtaatatattccgcatctcttttgacgtcaaataatccgtcatagtaatctttgtcaacgttcaggctgtggtaaagctcattatgatcaacccaaatgtttttagaagggccttcaatgccgatcgcgtctttatcgcctgaggcgacctcgtgaattttcaagttgcggatgatgatgttgttggcccgccatattttgatgccgatccctttgagttcccctttggtccctgatccgacaatcgatacgtttgacacgtctttgacgtcaatctttgatgcggatgtatttgatgttgtaatggtgccgttgacataaatttttaaaggcgtatttgcattcttattttttaatgccgcaatcagctgatctcccgttgttacggttaccgtctgaccgccttctccgcccgttgttccgccgtttagtgcggcaaagccttttaagctgaagtcggcaagcggatttactttgcccgagtttaaggcagaagctgcttctgccgaaaccgccgctgtcaatgacccgacaacccctaatacaaagataaagatgatgctgattaatttcttcattatattcctcctattgtttcttttttgatgccaacgctgaatgggaagcgcttacaattacggcggatactgaatggtgggcaccgatcatccctcccttttattggaatcagagagagcatagcatgtatttctgaattgtctgaataatcatgttgtgagttggatttgctcataagctggtgattatgccaaatgacacgaatctgagaataagcgcatttggatgaaggtctttcatcgtaatgttgcaaaaaaaatctatggatgaaaatccatagattttgattttaaaacacgttttctcttttaaaagctttgctgttctttttgataagcgcttgaggcggactgagctgaagcagttccggcagttcttctccatattggcattgcagcatgccgtagccgactccgcttaaaccaagcatgagcccggctgaatccacacctcgtgatacccctttactgaatggattttcttgaaaatatgtcaacagccgatcttccgtattctgtataatggtgttcagttcgctgaattcttccctgaaccctcttaggatttcgagttggccgaaatcgccgtgacagaatgagcggttattgccgaacccatgcttaacagttgtttcaagagcgttcaagatgtcggtatgcagcccgggatcattgactccgttttctcggaggatgcttctcgacaacaatatgccggcagcgccatggcaccatgcaactgacagttgttctcttccttttgatccccaatttttttcggaagcgatgtacagctgcttttcaaatgccaggcattgcgaaatgatttttttcagtgattgcgaatcaaacactttattgaatcgggataaagctgcggcgatgccggaagtgccgtgggcaaatcctgtgtaatagttttgtgtatgaggatctttccaggccgctccgttttcaatatttgttttatgctgaagcaaatggccggcgcacttttcggcgagctttagaaaaaccgggtcatccagttgttcatacaatgacatcagaaccattagagcaccggcagaaccgctgatgatatcgcagttttcgtcttgttcgatgacagcttcaaggactggcagagcttcatgtatgagttcgatccattcgttttttttctgaaccgttcccgcatgctgcagaaaatacagatagccggaaacccccgtgaatgccccagagtcggcgtacttcaggaattcttctttttccttcagttcattcaacgctcgctgaatcgcaaatacacactgctcggttatatgcgagtaagtctccggccgttttgcgaagcggctcagatagctcataaaaaatccgatgcctgcattgccattatataaatcaagactgacaggggagatcgtccaagagatttcttcgacgccttcaataactgtactgatccaagtgacgtcctttccatcattgccctcaattcgcttttcagccaaatcgtcagccgctttctcagcgatggcgagcggctgcaaggcgcctgatctaggactcgggtgattttggtctatatcgattgcgtctttttcatgtctcgcgttatatgcagccagaatcgacatgcgtatgacattcgcttgttcctttaagtcctggtctgaaaatgatgagatcttcttaattactcttgtgaaggacggcgtttcaaaataagcggcaatcggttcttcttcgccattgagcaaataggtatctgaaggcttcgacagaaaataggggatgtctccccgaatgagctctttcagctctgtttttgccgctgcaatatctgtgtctgcatcttcaaacttttccacccggcataaaaacacttcacggtctaccgcatccctgagaaaatcagggtggtagcttttattcaaaagagaggcgtagtgcgctgtcggcttcaaaatatttcgaacggtgcagtttttaaaatgttcaatcgtagccaggtagctttcgccatgatcagaaatcagacggtatactgctgaaaatccttcgatgatacaatgaagataatctgcgacagggacatgctggtgatctaaagtcggcagatttttcgcctcgccgatttcaaagcggtcatgctccaggcgaatgtcatcgcggaaaaatcctttgatttgaagcgcctgaaacggtgattcctgagcttcctgcccccccattccgctgatgtccacaactttatcccggtttttccttccgaagtaaaggttgaacggcaggattccagtagaccgtacggatctggaaagaatgtagtttgctttgtcaacggcggtcgagccgggttcgtctcgttttttatattgatgaaaaattgattcaagatcgattaaaacaggatgctcgccggaggcgataatgttttcgtggtgaaagtcaacggcatcgatgctgtataaaacggccaaaagtttgccgaggcgtgtatagtagccttccagttcttttttcgtatggcacgtttcgtgaggaataaactcggaccatccgtaccgttttttattgattaatctcaaagtttttaaagggctgcctgaatttcggtcattgatccatgatagaagaagttgaaatgcgtcgtcaacatcatggcttctcggtttatagacaatcttttttccatcggaatatgtaaggatggctgccatctttcctttattgtgcgagtctcccaccccaagctcaatatggacaggatcgccggcaatatgaaatgcagcctgcagctgttcgcggtcctgcctcagcctcttccacagttcagaaaagttttgaacccagtaatcggtttttgtgcacagaaggcgcagcaatacgggatactcgttgaacagggtccgcaggtatcctggattgactaaaaagttatcattgaaatcaagatagcgcatttcgggggtgtcgcccttcaattgatcttcaagccttaaaatgtttagttccagtattaatgtttgatgggcaatttgaagaagcgtctgttttaaatgtgtcagcacctgccggcaaagaggaggagaaagtatgatattttgttcctccaaagcatcttgtgctgcagacgcaaaacgggtcagcagggagtcgaacagcaattctgaatcttgcagagcagaatccttgtaggaaaagggcgtttcaaagatccgcttttgcatcttctgccatgggccgcgacggctgtctttcagcccgactgactgggataccgaggattgtgcgatggaggacaaagggtcatggcttaataatgaaactgctttattgagccatttatcatcatcgccgaaaagggaacgccaatactttatcttatcgtttacgagcggggattgagtttgggcgacgggaagccgttcgtgatatccggcggatttttcattcattctatcgacctctttttctatcaatatgccaacgcgggagcagggcccccgcgttgggaacttagttacagcttggcatgcattcttttgtcactgtacacaggtatccgttatttcctaacggcttgctcaagatggcacaagtgctgagcgtgattgtgcctccggcgatgctgtgctgttcctcttcctggagttctttaaggatgttccctgctggatgataagaagattcagtgcgatacataggatttttccatgaaagaatcatttccttttttgacatatattccacctcctagaaaatttataattttttgtcgatttcttgatgtacttatagtataatttgactggaacggcgagtcaattctaaattataggaaaatttcgatagtttgcccgttctaggaggtgagaatcatgaaaacaatgaaaaattcagctgcccgtgaagccttcaaaggagccaatcatccggcagggatggtttccgaagaggaattgaaagctttggtaggaggaaatgacgtcaatcctgaaacaactcctgctacaacctcttcttggacttgcatcacagccggtgtaacggtttctgcttcattatgcccaacaactaagtgtacaagccgatgctagggaatcataaaaaattcaaaagaatccatccttgcaacggagttgcagggatggttttcttcgccaaagggatgacgagaatgagcatgaaagaattcgaaatttatctgtataaagctctttacagcaatgaacgaggcggtcaaggtcaagaacatccgtccggcttttttccggaaaacggaaaaactccgtctcgtcctacggattttcacctttcttctgtccaacattcacccaatgagcctgtgcagctgcaaggcaaaatgccggaatgggctgcctgtttgtctgaaattatgaaatacaaccctaaagcggtttccgaattaaaacacccgcttccccacatgtcatttgtcaccttctttgttccttttcttttatttgcacaagaacggatgtcgaaagctttttctgaatttgagaagcaggaaggcggtctatccggcataatcgacgctgccggctatcaagacggcatcatgtctgaacttcaccaatgccttgataagctggcgacgagaacacttatcacagagctgaatgtagcccgggaagacggccggctaaagggggcgtcaccggaagagcgatatgtttactttgttgaacaatacatttccgatcctgaaatttaccgggaatttttcgagctttaccctgtgcttggcaggctgatggctgagaaggttctcagggtgctcgagattcatgaagaaattattgggagatttttaagcgaccgcagcctgattgcgaaaaaatttaagatcgcttcccccgaattggttggatttgaaggggatttgggagattcccacaaaaacgggcagagtgtcaaagtgctggtgttaaacaacggaaagctcgtgtataaaccgcggtccttgtcaattgacgaacattacagggagctgctgaactggctgaacggacggggaatgaagtacagcctccgtgctgcggaagtgcttgacaggggaaattacggctggcaggaatttgtaaagcatgaaggctgttcttcagaagaagaactggaaagattttatttccggcagggcggacatttggcgatattgtacggattgcgctccgtcgattttcataatgaaaatatcatcgcctcaggcgaacaccccatcctgattgatctggagactctttttgacaaccatgtcagcattttcgctcaaaatcaaaacctccatgtcaccgcattggagctgaagcattccgtgctgtcttcgatgatgcttccggtcaaattcaaacatgatgaagtgctcgattttgatttaagcgggatcggcggcaaaggcggccagcagtcaaagaaagcgaagggctacgccgtcctgaattacggtgaggacaggatgtctttaaaagaaacatcgctgaccaccgaggaaaaattgaatgcgcccaaactaaatggacgtccggtgtccgccgtttcctatacggactttatcgtggaaggatttaaaaatgcttatgccattatgatgaaacataaagaagaactggcaggaccatcggggtttttgaatctgtttaagcacgacgaagtccgccacgtcttccggccgacacatgtgtacggcaagtttctcgaagcgagcacccaccctgactacttgaccgccggagataaacgagagcaattatttgattatatgtggatgctcgccaaacagtcggaaaaggcaaacgtgtttattccggacgaaattgtcgatctgctgctccatgatattccctactttactttttatgctgggggcacttccctgctcaattcaagaggggaagaatcggaaggtttttatgaaacatcaagtattgatttggcaaagaaaaaaattcaatctttctcggaaaaggatttgaatcatcagctccgctatatttctttatcaatggcgacgttgattgaaaatgtctgggaccatgcagaaagcgggcttggacagaaggaaacggtcgctgatctcggaaaagaggtcaagcatatagctgatgatttgctgcagaaggcgatctattcagagcgcggtgaaggtcctttctggatcagcaataatgccggagacgaaaaaatggtgtttttgtcgccgcttcctatggggctttacgacggaatggcagggctggcaatattttttgcacaagcaggcaaggttctgaacgagcaggtatatacggatacggcaagatcaatgatagaagaaattcaaaaggaagaaagttattgggttcaaaatgggaattcccattctgcttttttcggcacaggctcattcatttacctgtattcctatcttggcagtctatgggaagacgattccttattggaaagggcgttgaacctcattccccgagttttggaacagccgaatcaaacacaaaacccggattttatcgcaggggattcaggattgctgacagtgcttgttaatctgtacgaaatcaagcagcacccagcagtattggactctataagacaggtactgagcagattgaatgatcgaattggccgcttacttgattcaatcgagcaggatgccgtttcgttgacgggattttcacacggcttgacggggatcgcattttctatcgcaaaggcggcgaaggtgatacacgatgacagctgcaaagagcttgtcctaaagcttgtcgaagaagaggaccgctattttcaaaaggatcatctaaactggctagatttacgaaatgattcgcatacgctgtccccaagctactggtgtcatggagctcccgggattttgctggggagagcgcacattcaggcttttattcctgaattgactacccggactttaaagcttcaagaagcgcttcaaagttctttaaatctagcagactgtcaaaatcattcgctgtgccacggtttaattgggaatttgaacattctgctggatatcaaaaggctgaaccgggaacttcatgtccctgatgatatattttgcatttataaaacgaaaaaccggggatggaaaacgggtttgcattccgatgtggaatcgcttggcatgtttgtcgggacggcaggaatagcctacgggcttttgcggctcctcgatgaatctgttccatccgtattaactctcgatattccgacgggcaggtgagataaggcttgttttttcataagacaccgtttatagaacagatgcagcagacggaatgcggactgtgctgtatggcgatggtagccggacggtatggttcgcatcatactctgcatgagctgagggatttatcgggatgcggcagggacggtatgaccctttttcatatgcgtcagctcagcgaaaatctgggatttgacgcaaaggtgtacagggcaggcgcggcagaacttccacatgtgcgtctgccggcaatcgctttttggtccgataatcattatgtggttattgatcaaataaaagaccggcatgtcaacatcatcgatcctgcgattggacgaaaaaaactcagtatcgaagcttttctcgaaaattacagcgggatcgtgctggagatgatccctaccgagcggatcaggccgaagaaaaaaccgcccgtctggaggcattttctttttcatttaaaagaatccccttctctgcttgcgaccgtgctgttgtttgcgatgatctttcagctcgtttcattaggcataccgatgctcgtgcaatacctgatcgatgacatccttgctcaaaatcagcaggctctgctgcaaacatttatgacgggcgttcttgttttaatgctcgttcaaggcacggttcaattgatcaggggtcaatttatcattaaattaaataacttccttgacaaacgaatgatgagaacatttttctcgcatattctgaagcttccctatcaattctttcaattgaggtcgttcggggatctccttttccgcgcgacaagcctccggattgtcagggatatgatgtcttcccaattggtcctcggcgtactcgattttggcgcacttttatttatctcgttttatatgttttataaatcgccgcctttagcagggctggttattctgctggctcttctgaatgtcgggatcacggcgctcagccgcgggaagctgagagaaaaaaaccaggacgaaatcgcaaagacttcgcagattcaaagctatcagactgagtttttatatgggatttttggtattaagactgcgggaatcgaaaaagaaacgtatcaaaaatgggatcactatctgggggaactgatcggggcataccgacgcaaggaagggtttcttaacatcgtgaactctctgacaggcacgatgcagatcatatcaccaatgctgattttatggattggtgcaatgctcgtgttcgaagggaatttatcggttggggagctggtggcatttcatgctttatccacacaattctttaatacaagcagctcgatcgtccaaaccgtcaactcggtaatcttgacgacgtcttatcttcatcggatacaggatatccttcaaagcccgattgaagagacacctggaaataaagacaactccccgattaagggggagatccggcttgaacgggtttcgttccgttacagcccgcacagcgaagaagttattaaagacgtaagcctgcatatcaagcctggcgaaaaaatcgctatcgtcggacaatccgggtccggaaaaagcacgctggcaaaacttattcttggcctctatatgcctacaaaaggcagtgtgttctatgatggcgtgaatattaaaaacaaggatttaagcgctcttcgcaaacaaattggtgttgttccccaagatgtaacgctgttcaaccgcagcattaaagacaacatttctttatacagtgaagatgttgacattgagcggatacatgaagtcgcaaaaatggcgcaaatatacgatgacattcaaaatatgccgatgggctttaatacgatgatttctgaaatggggatgaatatttcgggagggcagcgccagcggattgccttggcccgtgcactgctaaaccgccccgctgtgatgctgttggatgaagcgacgagttcgctggatcatcaaaatgaaaaaaaaatcgacgcctttttaagggagctgaaatgtacaagaattgtcatcgcgcataaactgacttcaatcatggatgccgataaaatcatcgttttggaagacggcatggttttaaatgtgggtacgcatgaaacattgctgaatgagagcaagttttacggagatttttatcgaaagttccttgaaaaagagcaatctgcagaggtgatgatgtgaaaagaatatatatttttctcttatgttttgcagtcctgctgccggtcggcggaaagacggctcaagcaaaagaacaagcaggagaacagtatcttttgcttgaacatgtaaaagataaatcgaaactgctggacacggcggaacaatttcacatccatgccgatgtcattgaagaaatcggatttgcaaaagtgaccggtgaaaaacaaaagcttgctccttttacaaagaagcttgctgaaaaagtcggggctgacgtcattgaaaagccgattgcaaatacagcagtaaacgaaacggaatcagtcatcagcggttcgcctgcatgggggcttgacggtattttggaactaaaagaatatctatggttcgctgcaaagcagacggattcctatcgcacgtatcaaatcgaaagagggcatccggacgtcaaagttgccttgattgacagcggactggatcttgaccatccggacttaaaagcgtccgtcaatacaaatggcggctggaattacattgacggcaagcctgtatccggagatccggcaggacacggaacacaaacagccgggatgatcaatatcattgcgccagatgtgacgataacgccttatcaagtgctggacgaaaaaggcggagacagctacaacatcatgaaggcgatggttgatgcagtcaatgacgggcatgaagtcatcaacatcagtacgggaagctatacttctcttgacagggaaggaaaagtgctgatgaaagcttatcaaagggctgcaaactacgctgcaaagcatcaggtgctggtcttctcttccgccggcaataaaggagtcaaccttgatgagatgaggaaaacggaaaacaaggtgcatttgccgagcgctttgaagcacgtcgtatcagtcggcagcaatatgaaaagcaacaatatttccccatactccaatcaagggcgggaaattgaattcacagccccgggaggatatttgggagaaacgtatgatcaggatgggatggttcgtgtgacagacctcgtactgacaacgtatccgaaagggaaggacaacaccgcattagaccagatgctaaacatcccaaagggatattccctctcatacggaacaagcttggccgccccgcaggtagctggaacagctgcactggttatatctgaataccgggagcgccatcacaggaagccatcggctaaacaagtgcatcacatcctgaggaaatcggcattagacctgggcaaaccggggaaagatgttatatacggctacggggaagtacgcgcttatcaagcgctgaaaatgatgaacaaggagtgaagggtatgtatgaatatcaaacagtttcaatcgctgtaggagcattcaacggaaaacttgagaaaaattattctgatgtgattcatgaatatgctgaaaaaggctggaagcttcacagcgtcttttctgttccatcaagggccggaggccaggtttcttctatcgaactgatttttgaaaaacctaaatcttgattgtcgaaaagatcttcacacaatcatcacgtgaagatctttttttagtctgttttggtaaaaaactttttactttttgttataaactctttacaatgtgtaaaaaacattgtactctatatatgtaaatgatttgcaaataaagagggtgattgagattgaaaagcaaagcggggtgttaaccaaccggattcctgtgctgcgagcagagaaagggtggacgcaaaagcagcttgccgatctattgggtgtaacaagacaaactgtgatttccattgaaaagaataaatacaaaccatccctgttaatggggtttcgcattgccgcgttatttgagaaggacatcaacgaggtatttcaataccaactagaggaggatgatcgctgatgctagaaatgatcaattcaattggtgctgtcgcaggatttgcggggtttatcggaatcattattttaatcagccttgacggaaaggatgaacgcggggcatatattcaaaacaaattctttcgggtgatgttctttttgcttacacttggaatatccgccgttatttttacaagttcatgggtcgatttgtcgttcgccaattataaaaacatggtcacactggctttttcgctgccgtatttcattggattcttcattttgttgggaattcgttcaagggtgtagccatggttgagcttccaattgtcatgaaccatgttgaggtgcgggcgggagacaggaaacttcttgaaaacgtcagccttgctgtggacaaagggagccgggttttgctcaaaggagaaaacggatcgggaaaatcgacgtttcttaaagcaattaccggcttgtctttatttgcgggcgaaattttgatttacggtcaatcgattatccaaaacagggaagctgctgtcgggcatatcggctatgtcagtgacgaagtgccgcttcatgagcaccttactggaacggacaatctgagagtccatgccttgcttcacggaatagatgacgatgaccggatctattctgaactagagcggttcggtatcaatccggctgatgacacgaaagtacagtactattcaacaggcatgaggcaaaagctgaagatcgcaatggccttatttcatcagccttccatcttaatattggatgagcctttaaatgggctcgaccgaaaagcgcaggaaagcgttgtagacatcataaggcggtatgacgggaccatcatggcatcaagccattggaacgaaacttttatcgaattgtttgatcgttttctagccatagaaagcgggcgtttaaatgaaattgtttaaagtttatttttggttaagctgtcccgaagcggtgaaaaagagaatgaaatttcagacgtttgcatgtacggttatgatcatcacggtgctcgccgttttgcttaattatcttctcttttataaaaacggggcaaataaagaaatccgtagcatggagggaatggctgtttatgtcgtctcggtttggctgacttatattacaggcagaagattatttggacgcatgatgcatcaagcttttatcttgcggtatcccgttcgcctgttcacttgggtgctgactggaatcgccgtgataactatcgtctcagcgctggtcttgctttacggctgtttggcagtcagtctgctgtttcaaaaggatgttttgttttcgccagagcgtttagccgctgttgcgatactggcggtgatcatgtcttccgtccagttttttctgaagacgttaaaggcagaatatctatttgtgctgttgatgacgctgacgccgttttttatgcaaagtggaacactttatttgccgtggggagtttcttggcttttgttgactgaatattcagtgaacgatataggcctggcagtttatcttatttcggcgggttatatagcggtctgtatgtgttggatcttaaggagcggggaggaaaagatccgtgaaaaatttgctcaaagcggaatggatcaaactcaggaactctgattttacaatgacgagcatattcattcttaccgcatctttagtgtttacagggtttatggcaaaacgaatcaccccgtttgcgggagggaatgaatggacatcgttaaggcatcttacattgctgttggtattcagcacgatttatccctggcttgtctcttcggtcacagtatttttgcataaggatgaactgaaaaaccgagtgtggctgaatcgaatcttatcgccgcagcctttcgcagccatgctttttgctaaggttttgtttattggactgttcgcagccgcattatatgccgtctgtgtgatcgaatcgcttgccttcggtttaatatcggggttccccgggcctgccccttggttttcttggatgctgggcttcattctcaatctcttgtcaacctttccgctgatctgtacggtcctatggcttaaattcaccagtaaggaaaagacctcattaaacattatcgtattcatttgttcactgctgagtttcggcgtttcgcaatcccctttagggcttctctttccatggtcttttcctgtgacggccctcattgcaatggagaagtcagttgccgttcttatcggttcgattgtttggttcacggcggtttcgctgctctttttttctcttctattgaaacagatcaggccataccaaaaaggaggaatacaaaatgagtcaagtcgaatttgaaggtgtaagtaaacgaataaaaggcagaccaattgtccaaaatatcacatttcaaattgccccaggtacaatttttgggctgctcgggccaaacggcgctggcaagacaacacttatcaaaatgattgtcgggatggcaaagccgacatcaggagatatccgcatcgacggctattcagttaaaagcaattacgaggaagcggcagcccgagtcggttctgttgttgaaaacccatccttttatgagcacttaacaggataccaaaaccttaaatatctcggcggattccacagccacgtgtcaaaggagcgcatagaagagatcgttcagcttgttgatttgacaggaagtattcataaaccagttaaaacgtattcattaggcatgaaacagcgtttgggccttgccgtcgcgctcttgcatgatccggaatttctcattctcgatgaaccgacaaacggccttgatcctcagggaatcattgatttgcgcgaacaccttcagtacttggcgaaaaccttcaacaaaacgattttgatttcgagtcatcttctgtctgaggttgagatgatttgtgatgaatacggcgtcatgaaaaacggagaactcctgcaaattaagagcaatcaccgcgataccgatacggttcgttatcggcttacattaaacggccacgccgatgaagcggctgacctgttgaatgagtaccagtatgcaggcggtctcacggaagataaaaatgagatttatgtcctttgcatggaagaagacattatgaaagtcgttaatctgttaatggagaacaaaataagagttctgcatatgaagcaggaaaaacagtcgatagaacaaagctttctggaattgatcaataaggggtgaccggcatgagggtcttgaaaaatgaactttacaggctgatggtgacgaaaagtacctggattgtgttaagcttgctgcttgtcatgacaatcgctgttgcatggatggtcagcaatggcgaaaaggagaaggagacaggtaactggaaagagcaattaaccgttcaaaacgctcagtatgaaagagaaatgagagagctgagcccagcggttcccaaataccaatttttaaaagaagagatcgcggtcaatcaataccggcttgagcataatttgccgccttctgcgaaatacaatgtttggacgatgctgaaggagttaaaaccgatcacaacattaatcgcgttgattgcaatcgtgctggcagcgaactccatcgcgcttgagcacagcaaaggaactattaaatttgcgattgcaacaccggtcaagcgttggcattatctattggggaaatacttgtcgatcttgctcaacactgtatttatgtttgctgcgacacttttatttgcgtttgttttagggtatgccctgctaggtttggagggaagccaatactatttgtcctatcgaagcggcgaagtgataaagatgtcaatgctgaagtttttagccttagactatggagccgctttattgaatattattgtgctggccacgctggcctttatgatttcggtcatcctaagaagcgcggtcgtctctgtcggtctttcgctgttcgtcttttttacagggtctgcgattactcaatttttagcggcaaaatttgattggaccaagtatacgatctttgcaaattcagatctcagtcaatacattgatggggagccgtttattcaagatatgactctttcattttcagcggctgtgattgctgtttattttattctttttctggctgtctccttttgggtttttcaaaagcgggatattgtcacgtcataacattgcagcaaaaagcggagctcgatttacagctccgctttctcctgttctgtgctgttgtatgttcgctccacgactgaagcaagcgtatcgatgaaccgcggatcagtgttcggcataggcggacggtgatagcttgcgccaagctcgtccgtaaccactttgcactcatagtcgttgtcatacagaacttccaggtggtcagatacaaaaccgactggtgcgtaaatgaatgaccggaagccttcttcatacagttcctttgttaagtcttggacgtccgggccgagccaaggatcgggcgtgttgccctcgctttgccagcctacggcgatctggtcaaatgacagccgttctccgattagttgtgctgttttctcgagctgatccgggtaaggatcgccatgctccctgattttttccggcaggctgtgtgctgagaatatgacggccgctttttcccgctctttttcagacatgtcgtttaaaatgctgccgatttcttcagaccaatagcgaataaagccttcttcctgataccactcgtcaatcgatgcgatccgtggtccgccgattgctgctgcggcctgtttggcgcgccgattgtatacttcggtgctgaaggtggaatagtggggagctaagacgacggaaacggcctcttcaatttggtcttttttcatttgttcaaccgcatcctcgataaacggagacatgtgttttaagccgagatacatcacgtattcgactttatcttggcgctcgttcaacgttttttccagctcttttgcctgagcgagcgtaattttcgcgagcggagagattccgccgatatgcttgtagcgttttttcaagtcttcaatcatatcatcggacggtcgttttccatgacggatatgcgtgtaatacggaatgatatcttcttcctgataaggggttccgtatgccatgactaacaggccgactttttttcgttccatatgtcttcacctctgctgctgttcttggcatgttgtacagattccatagattcctagaaaatgcgagttcactttaaagttcgtcaattgtgctgccgcatgctctacctctttgaggtgaggatagtccagatcagcgatcttcccgcatgatttacaaatgacatgataatgctgtgatgtaaacagttcatatttgctttttgcgtctccgtgagacagctcttttaaaatgccgagcttcacaaatagtttcaagttgctgtagattgtcgggagactcatgtacggcaattcccggtgaatgtcttccgccgatggatggccgcccaaagaagcaatcgtttttaaaatcaggacgcgctgagctgtaattcgtaaaccccgcttttttaataaagggacgagctgctcgtcttccacacgtaacatcccctgtcgttctttgattaagggcaggcacccgcatgcttaagaggacgggtgcctgtacctgagaaaatgagaatttcattgagaatgattgaaatgatattagccttaaacttcctgcggaacagacaagcccaatccttcggcaactcgtgtgccgtactccggatctgctttatagaaatgctgaatttgacgaagcttaatttcgtcttttgtcacctgcttcatcgaacctacgatattgctgacaaggcgggtccgctcttcttcgctcaagaggcggtaaagatctccggcctgtgtatagtggtcgttatggtcgtaggctgtgctgtccgccgaacctgacaccggataagccgttgttttgttttccggagattcctgagggcctccgaagctgttcggctcatagtagacagagccgccgccgtttgaatcaaagcgcatttgtccgtctctttgataattatgaacttccgctttcggacggttgatcggcaggctgttatggtttgcgccgacgcggtagcggtgtgcatccgcatatgcgaacaggcgtccctgaagcattttgtcgggagacggttcaatgccgggcaccaatgttccaggggagaatgtagcttgttcaacctctgcgaaatagttttccggattccggtttagaaccatgcggccgacttcaatcagcggataatctttttgcgaccatacttttgtcacatcgaacggatcaaaacggtacgtatccgcatcctccagcggcattatttgaacgtacagcttccatgccgggaagtcgcctttttcaatcgcctcatacaagtcctgtgtgtgataatcggggttttcacctgcaatctttgtccccacttcttcggtcaggtttttaatgccttgttctgttttgaagtggtatttgatccagacgccttctccttcggcattcacccatttgaatgtgtgggagccgaagccgtgcatgtgccggtaagtcgcagggatgcccctgtcagacatcaggatggttacctggtgcagggattcaggagacaatgaccaaaaatcccatacggcatccgggtttttcaaatgtgtgaccggatggcgcttttgtgtatgaatgaagtcagggaatttaatcgcatcgcggataaagaaaacaggtgtattgtttccaacgagatcatagttcccttcctctgtataaaatttaacagcgaaaccgcgcgggtcgcggacggaatcggctgaaccgttttcgccggcaacagttgaaaaacggacaaataacggcgtgcgttttccgacttctgataaaaatttggcttttgtatatttggaaacgtcatttgtgacttcaaaataaccgtgcgcaccggcgccttttgcatgcacaacccgttcaggcacacgctctctattgaagtgggcgagcttttcgagcaagtggacgtcctgaatcagcgtcggtccgcgtgaaccagctgtcattgagttttggttgtctccaactggagcgccccagctggttgttaggttgtttttatttgtcgtcatcaaaggatcacctcgcgtaaattttaattacaaaacaatgataacatttctcaagaaaaaaacaatatttatttataattattataaagaaaaatttattatcgttgatttgatcatgataaatgctgaataacttttctggattgggataaattattgttaattccaaataaaggaggaagaagaatggatcagcattcaaacgagcagaaatctgacatggagactgatgatacgttaacaaaccggcagggccacccgatcacaaacaatcagaatatcagaaccgtgggcaaccgggggccatcaacattggagaactatgatttcctggagaagatcagccactttgacagggagagggttccagagcgggtcgtccatgccaggggagccggagcgcacggctattttgaagcttatgggacagcaggcgatgagccggtctcaaagtatacgagagcaaagctttttcaggaaaaaggcaagagaaccccggtgtttgtccgtttttcgacggtgactcacgggatatcctcaccggaaacgctgcgggatccccgcggatttgcggtcaagttctacactgaagacggtaactgggatctggtcggaaacaacttgaagatcttctttatccgcgatgcggtaaagtttccggatttaatccatgcatttaagccggacccggttacgaatttgcaggatggcgaaagaatctttgacttcatttccaacacgcctgaagcgatgcatatgatcacatttttgttttcgccttggggtattccggcgaactaccggcagatgcaggggtccggggtgaacacgtacaaatgggtgaatcaagaaggggaagccgtgcttgtgaaatatcactgggaaccgaagcagggcataaaaaacttgacgcaaaaagaggcggaagaaattcaggcgaagaatttcaatcacgccacacaggatttatatgaagcgattgagcgcggagattatcccgagtgggagctgttcgttcaaatcatgagcgatgatgagcatcctgagctcgattttgacccgcttgacgacacgaagctgtggcctgaagatcaatttccttggctgcctgtcggcaaaatggttttaaacaaaaatccggaagactactttacagaagtcgaacaagcggcatttggaacaggggttcttgtcgacggacttgacttttccgatgacaaaatgcttcagggacgtactttttcctactcggatacacagcgctacagagtgggagccaactatctgcagctgccgatcaatgcgccgaaaaaaagggtggcaaccaatcagcggggcggccagatgcagtacaaggtcgatttaggcaaaaatcaaagcccgcacatcaactatgaaccttcaaccatcaacgggctgaaagaagcaaagcaggatggcaaagaatacaccccgcatgtggaaggaaaccttgtgcgcgaaagtatcgacaggcagaataatttccagcaggccggggacacttacaggcatttcgaagactgggaaaaggacgagctgattacgaatctggtcaatacacttgccccgtgcgaccaaagaattcaaacgaagatgatcgatatgctgaagcaatgcgacaaggaatatggaagcagagtcgaggaaggattaaaaaacgcctccagccaaaatacatccagccgggagccgatcggagcagaaggcgccgaagatgccccgagacaggcggaagaaaaagggcactctcaagacccgtattaaagaagaaaacagcgatgaacctcttgtgggattcatcgctgtttcacttacggaagaccttcgtcggctgaacgatatttgaggatttatcccgtcttcctgctgtaaatatacgaaactgtttggaaaaaagcatgatacatgcagcggccagtgacaatgcgccggcaaaccaaaacacctccggcagcccgaacagttcagccacttttcccgccacaaccggtccgagaaaaaaaccgagcgcataaaaagattgatagaaacccatcacagacattttgagctgaggcgtaccaagctgaacgactttgctgaccaaaagcggaaaaataaatcccaatgtcagtcctgtcacggcgtggacgatacataccgcgaaaagggtttcggcaaacggcagcaagcaaaagaaaacagccgttatcacataagatatccatatcagtgcatcggcggcctttactttgtaaaagatacaccacacggaagccagcgtttgcggaacaaaaaaggcgaacataacccaaatcagctgtttctcatcgattccgaccgattccgcgtaaatcggcgtaaatccgaacacggtcataaatagtacagcgtgggctaaaaacgataatgttgtaatcgcttttaaatcaggaagacgcaacgtctgtttaacatagtctgacaaagccatccccttggccgtatggcggggcccgttatctttaatgtaaaatgacagaatcagtccgatgcatgatacggcaacaccgatccaaaacggaaacatccagccgaacaaatggacgaggtagccgctgactgccatgctgatgaattggggaaggaccgttaaaaactgcaggatgcccatcgcttttgatgattgatcttttgtaaaatactgcgagtataaaacggttgccatcacccacatcgccgcggtcataccggcgagcagcctggctgtgatcaccatgatgaacgaatcggacaacagaaatatgcagcagctcaacagagacattgcaaagccgctgatcaacagctgttttctaagcggcgaaagaacatcagacaggatgccgaacggaaaacgcagtaatatctgagtgacgccgtagcttccaagtacgattcctatcgctgaatatgaaaatccgatgttgtctaaatataatccgaaaacagggacatagatgtatgtagcaaaccagaaacaaaagacggcaccccaaaagatcatatgatctttccttaaaatttgtttttcttcatagacgatttgtttttgccgctccatccctttttactcacacccctttaaattcaagtacatcataaatcccggccgaaaaacaagatgattttttatcttattgaaatagaattgaacggtttgcttgcaggcgtcgtcctagatacagagacaaaaagaaagggggtttgcgttttagtggatcaagcagatgaaaaagaactgatcatacgggcaaaagacggtgaagatgcggcttttacgaaactgtttcagcttcattacccctttgtatatcaatatgttctgaaattaacgctgaacccagatctcacagaggacttggtccaggaaacgatgctgaaagcgtatgtcagccttcatcagtttcagggcaatgcaaaattttcaacatggctgatctcaattgcttcccggctgtttatcgaccatcagcgccggaaaaaacgcgaaaaccgcaaaacgcaagcagcaggagaggaagccttgcgaaaaatgaaatggaattctgcccttcacggccacgaatggagcgaatacttggagctgtttgctgcgcttgagcctgagttcagaatgccaatcttgttaagacactattacgggtttacttaccctgaagtggcaaacatgctgaaaataaaagaaggtaccgtcaaatcgcgcgtgcatcatggattaaagaaaattcgaaaggagtggggacagtgaatgaacgagatgaaaaagaaacggttacacatttgaaacgcgaactcgaaagaattgatgataattttgtgccgccggttcctcaagcatttgaactgaatcagcgtttagcgcggtttaagcaagagcgcaagcgggcgcttaaaaaggaattgctttgttttatcgtcatggcgctggtgattttatcggcctacttgacgatttccgttcaagtaccggctgtttttatcatggtgcagggagcggcgcttatcttgctgccagcgcttgccctgatagaaaaaaggcggcatacggctgatgaggaggctgattaaatgaatcttgacatgactcaggaaaaactgctgctgctgctttgcatttcaccgcttttatttgcgcagagtatctttctatttcttaatgcgaagaaaaagggagccaatgcgtggttctggggaatatggggcttgatccaaacaccgatgcctttattattctattatttatttgttgtaaggccgtttcataaaaaaaggaggccgttatcatgactggagcagatataccttgggcgctgctcgcccctttcattgtgctgtatttcattttagcagtgtccgcattggtcagttgcataaaacaggagaaaacgaatggcccaaagtggatgtggattttgatcattttcgggatcagttttgtcggtcccgtctcttactttatcatcggtaaaaaaacatatgagaggaggcgggtgtgatgctgtccgtcaatggcttaacaaaaatgtatcagcagcaccaagctgtccaaaatgtcagctttgaccttgaatatcagcaatgcgttgcccttctcgggccgaacggagcgggaaaaacgaccacattgcaaatgctttccggtttattggcccctacatcaggacgcatccgctttttggggagagaatcgataaacaggctggaaatcggatatttgcctcagcatcctgcgtttttttcatggatgacagctttagaatatacggtattcgctgcaaggctttccaaaatgaaacgtcgtgaagccctggaaaagagtcgaaccgctttgcgctatgtcggtctggaaaaggaagaagaccggaaaatcggcggtttttcaggagggatgaagcaaaggctcgggctggcgcaggctttggttcatgagcagaggctgttgattttggatgaacctgtttccgcgctggatccggcggggcggcgcgaagtgcttgatatgatgaaggatttaaaaaagaagatgacaatcctattttcgactcatgtgctgcatgatgccgaagaggtgtgcgatcaagtgatcatgctgaaagaaggggctgtcaaatggtctggtccgcttcacagattgaagaaccgtcatttaaagccatcatatatgctgacagctgaagaaagtcttgaaggatggctggaacacctgccttatgtcagcaaagtcgtgtatcataagccttcacaagctgaattttatttaacagatcggtctgacagccgccgactgttggctgaatgcttgaacagacaagtatcgattgttcgttttgaacaaaaaacgatgtccttggaagatatgtatctgaaggtgatggggctatgaattcattttttatgttatttcaaaaagaatggacggaaagctggagagacggaaagctgctttggctgcctgtcattttgatccttctgggcttgattcagccgctcagcctgtattatatgcctcaaattatcgatatggccgggaatttgcctgagggatccgtgatcgacataccaaggccgagaggtgaagaggtaatggcgagcaccttgtcccagttcggcacggttggtacggcaattttcgttttcagtgtgatgggcagcattgtccacgaacgaaaccaaggatccctttcattggtgatggcgagacctgtcagcccgcttcagtatatcggcagcaagtggcttcagcaggtgctgctcgtattggtttcgtttgctgcaagctacggtttggctttctactatacaaatctgctattcggcaaggttgaatttgaccggtttttagttagtttatccgtgtacagtatatggattatatttgtcatgtcggtcacgatgtttttcagtgctctgtttcgccatatcggggggattgccggcatgagcatctgtttcatcgccttcgtttcattggcgggatccttatttccccgctttaccgaatggatgcctgataaggcgaaaagccaggctgattattttatcatgcacggttcatgggaccatgctttcggctggatggtgttttcgtctttgggaattgtaattcttttgttcatgtgcaccgtttttgtttttaaaagatatgaatcttactaatcagccgggctcgcccggtttttctaattgtcatcttcataacttaaggtatacaatacactggaaggtttcgagggcgtatttaaaaatataataaaggagtgatccaatgggtacgcttaacagccaggcagatcttgcggctcattcgaaagcaaagccgaacagggtatggatcgctgtcatattgggtattttatcgggaatcggtccggttgtgatcgatttatatttgcccggccttccacagatggcaactgatttacatacgaatgcttccgtcgttcagctcagtttaacatcgtgtttactggggctggcaatcggccaaattgtcatcggccctttcagcgatgtccttggaagaaggcttccgctgatcgtgtcgctgtccgtttttgccgcggcctcttttttatgtgctatgacatcttctgtatgggttttgatcgcgatgcgctttattcaaggcgcggcgggggcaggcggcatcgtcatatcacgcgcgattgcccgtgatctatattctggaacagaattgacaaagttcttttcgctcttgatgcttgttaacgggatagcgcctatcatatctccggtagcgggcggacagctgatgaaatggacgacgtggaacggcgtatttttcatcatcggcctttttggcctgctgatgattttgtccgttatattcggggttaaagagtcgctgtctccggaaaaccgtacggcaggcggattcaaagagacgtttgtatcatttggaaggctcttcggccagcgtacatttatgggatacgccttggcgcaagggctgatcgtagcggggatgttcggctatatatcggcctctccgtttgttttgcaggacatttacaaattgtcggctcaagcctttagtttttgtttcgcattaaacggcctgggcattattatcgcagctcagattacgggcaggcttgccggccggttcggtaaagcgtcccttttgcggagcggtttgctgctgtcttttaccgcaagcgttgttttatttgtttctgtcttttttaaagctccgctgattcttattttaatcccgctgtttgtcgtggtttcctgcatcggaatcgtgacgacgaccagcggatccttggccatgcagagccaggggaaatcagccgggagcgcatctgcgcttctaggactgcttccgtttattttaggagctgccgcggcgccgctcgtcggtattgccggaagccatacagctttgccgatggcagtcgtcattctgttttgcaatatcagcgcgctcgcttgttttaacatactggttcggcgggcagcgcttaaatgaaaaaaagcctggcggctcttatgccggcaggcttaaaattttaccgtggcaggatatcaactgtagcttctgcgtggttgtagtttcgcccgaacttttgcagctccgcggtgattctgtgagtgccggcgtttggaagcgttttcctaaccatgaccagtttgaactcagaagagctgaaagcgtaaaccggcactctgaccgtttgcccgtcatttaaaatctgtgtatagttcagtgttctgccgttcagcgaatctctcgtattcgcatggaagcggtatgggaagttaaattcaacatagcttgaaccgacaaaaaagttcggtttgtaagtgacttcaatgtctgaagttgtccattctttattgctgtcaaccgtctcgacatgcagcgtcggagcgtttctgtaaaaagtggcgctcgcctcttccgtcggaagaatgaaagaaaacaatgcggctgaagttaataggccgactccaattttaccgataaatttacgtttcaacatgtacttacccctcctaataaatgtttttaaaaaatgatgaaaaaggaaaaaataagttcggaatctactatattccttttcccgctccatcaatctatcatcatttaccaatcaagtaaatatttttaaaggaaaattctaaaaacatttaaaaaatgcatgatatgtaaagaaaaatactatagaacggctgccggcacattcatgccggcgggccgaacattgatttaacgagggacaatctccaaagttgtttcagcatggttgatgttttttccattttgctgcagttcagcagtaattctgtgagtgccggcatttggaagcgttttccgaaccatgaccagtttgaactcagaggaacttaaagcatagacaggaactctgaccgtttgtccatcatttaaaatttgtgtatagtcaagcgtttttccatttagtgtatctcttgtgcttgcatgaaagcggtacggaaaatgaaattcaacatagcttgaaccgacaaatgcgtttggtctataagtaatttcgatgtctgaagttgaccactctttattgctgttaatagtttttgcctcaagcacaggcttctgagtcgggttatccggttgcggattgtccggctgcggtttttgaggcggctgtggtttaggtgccggcttgaatggcggcggacaaaagatcggtcctctaaaatgatttgttttcacctcttgagcatttgctccttgggtaggaatgataaatgaaaacaatgctgcagaagctaatagaccaacactgattttacgaatgaattttcgtttaagcatcgataagttcctcctaattgcaatgtttaagttaaagtagaggacgtcctattattttcaagaaaaggcagaaatgagatcgcgatcaactatattccttttcttgtttacttaatctatcaccatttaccatccaagtaaatatttttagataaatttctaaaaaaattagtataaattgatagttttctgtcaattgacgccctttttttataaaaaggagtcgcataaagaacaaaatggttaattgtgtatatttgttgcagttccttgaggggcgttttaatataaataaaaagggatcagggggatggatgatgcgagacattcagttgtttttggccggggactcaacggtttgcgattatgatgagaatagggcgccgcgtgcaggctgggggcagaaaatcggcgagtttttaagcgcaggtgttttgatccgcaatgaagcggcatcaggaagaagctcaaaaagctttattgaagaaggcaggctgaagcgaatcataacacagatcaaaagcggcgattatttgtttgtccagttcggtcataacgaccaaaaaccggatgatcgctatacagagccatacacaacttacaagcagcatttgacccggtatatagatgaggcacggttaaagaaagccaatcctgttctgattacaccggtccagagaagatcatttgcaagcgatggccgctttaaaaatacccatggcgactatcctgatgcgatgatacagcttgcggaagagcttcgggtgccgcttatcgatctcgccttcaaaagccgtcaattgcttgaatcgctaggaccggaagcttccaaaaagctgtatttatggcttgaaccgggggaacaccccaactatccggacggagccagggatgacacccacttttgcgacttcggggcaaaagaaatcgctaagcttgttgcacaggaagcaaaagaagcgggaattcctttataaaacagcctacttgagaataattttcaattatttttcgaaatttttgcacttccgatgccaaactgtgatacgatcaatctcgtaaagattttcaaaaggagtgcacatcatcctatgatacgccgctttttttcatactataaacctcataaacgtttgttcttcatcgatttcagcagcgcgatcgtcgttgcagtgctggagctggcttttcctctagttgttcagtggttcattgatacgctgattcccgggggagactggcttgaaatcgtctgggtaagcatcggcctcttactgatctacctgctcagcacaggtctgcagtacattgtcaattatctcgggcataagctgggcatcaacattgaaacagatatgcgccaggagcttttccaacatgtacagcgccaatctttccgctactttgacaatacaaaaacaggacatatcatcagccgcatcacaaatgatctgtttgatatcggagagctggcccatcacggaccggaagatttgttcatcgccgtgatgacctttttaggtgcattttggattatgctgacgattaatgtgaagcttgcattggttgcagttctgtttgtgccgttattgattatcttgatcacctattccaatatcaggatgaaccgggcttggcgccagatgtacagcgaaatcgccgatgttaatgccagggttgaggacagcgtttcaggcgttcgcgtcgttcaatcttttacgaatgagcgctttgagatatcccggtttttaaaaaacaatcaaaagttccgcaaggcgaagctgaagggctacaaaacgatggctctcacgactgccggaacctttttgatgacgcggctgatgattctggcagtgctcgtgttcggagcttggctcagtttttccgggaatatgtcctacggggaattcgtcgggtttgttctttatgtcaacgtgctgtttaagccgattgataaaatcagcgccattttggagctttatcctaaaggaatggcaggatttaagcggtttacggagttgatcgatacaaagccgcagattgtcgaccgcaaagatgcgattgatgttccggcgctggaaggaaacatcgtcttcaagaatgtgacgttcggctatgaaaaacataaacccgtcctgcgaggcatcgatctgtcaattaaagccggagaaaccgtcgcctttgtcgggccgtcgggagcgggcaaaacgacgatcagctcgctgattccgcgcttttacgatatagacggcggggccatcacaattgacggcatcgatattcgcgatatgacaaaacgctctctccgttcgcaaatcggcatcgtccagcaggatgtgtttctttttacgggaacgctccgcgaaaacattgcctacggaaaactggatgccacagatgaagaaattcagcgggccgccaaaatggcgcatttggaatagctgatcgagtcgctccccgacggttatgaaacccaggtcggcgaaagggggctgaagctgtcagggggccaaaagcagaggattgccatcgccaggatgtttctaaaaaacccgccgattctcatattggacgaagccacatcagcacttgacacagagacggagcaggtgattcaaaacgctttgacggagctcgcaaaagacaggacgacgcttgtcattgcccacagacttgctacgatccgcaatgccgaccggatcgtggtcgtgacagagaatggaatcgcagaagaagggacacatgatgaactggttgagcgcggcggtattttcgcaaatcttcatcgtgtacagtatcagtcgtaaatgattggaaacaggcaagcccatgtttgggcttgtttttttaagggcaaaagaccttgaaaagaaagggaacggatgctacactttcgttatatattatcgatatcggatttcgatattgaatttcgttaaagggggtgcggtattggaagataaggtattgcgaaagctatttctaggatttattcaaattcatattctgcaccacgccaccgaacacccgattttcggattgtggatgcttgaggaattgaaagagcacggatataacatcagtgcgggaacgctgtatccgatccttcattctatggaagctgacggacttcttcgaaaagaagaacagaatgtggacggaaagatcagaaaatactattcaaccacggaaaaaggagcaagcgtactgaaggaagccagattgaaagcatatgaactgtttaaagaaattaaagaatagaggagtggaatgatgacaaagcataaagcggacagaagcttgaagtcgctgcttgaaattctattcgtttcaaccaggcttggattgacatcattcggaggtccgatcgcacatttaggatattttcatgccgaatatgtccgtaaaagaaaatggatggacgaaaaaaactatgccgatctggtcgctttatgccagtttctgcccggtcctgccagcagccaggtggggatcggaatcggcgtgatgagagccggcgtcctcggcggaatctcagcgttcatcgggtttactcttccatctgtcatagcgcttgtattatttgccatggttctgcaaggcttcgatattggaacagccggctggattcatggactgaaaatcgtcgccgtcgccgtagtcgcccatgccgttatggggatggcgcaaaagctgacacctgataaaaggcgcaaagcgattgcgctgtttgctctggtcgccactcttctctggcagacggcttttacacaggtcggagtcatcctgctcgccgctttcgccggatatcttatctataaagagcaagttgaaacggatgattccgtcatgcagtttcctgtgtcgcgccggtttgcagcggtctgtctcagcttgtttttcgggcttctcattttgctgccggtgctcagggaaatgacatcttccggctggattgccatgtttgacagcttttacaggtcgggttctttggtcttcggaggagggcatgttgtcctgccattattagaacgggaatttgtaccggcgggatggttaagtgaagaggcatttttggccggatatggagccgcacaagctgttccggggcctttgtttacattcgctgcatatcttggtgcggtgatcagcggctggcaaggcggattgctcgccacagcggcgatttttctgccggcgttcctgctgattctggggacgctgcccttctgggatacgctgcgccgcaatcctaaagtaaaaggcgctttaatgggagtgaatgcagctgttgtggggatattgatttccgcgttttatcacccgatctggaccagctccgtattggcgccgatcgattttgcattcgctgcggttttgttcagcctgcttgtctactggaagctctcgccgtggatcatcgttgcagccggtgctgtcggcggtgcgatgttgcagctgttgtaagtggagaaggctgccgatcattcggcagccttgtttcgcgtatcaacggtgttcttttccgatttcgggaagcaccgttttggcaatattttcgtccagtttttcatagtcgtagtaatgaatcgcatcatataattcttcgcgtgtctgcatgtcatcgagcacacccttttgcgtgcctttttcgaaaatctccgcgaagacccgctcataagctttcgcggcggcgcgcagggaagtcacagggtaaataaccatgctgcagccgagcatttggaattcgtcagccgtataataaggcgtttttccgaattcggtcatattggccaggagcggcgctttaatggaagaagccatttcccggaattcggctgcgctcgttaatgcttcaggaaagatggcatcggctcccgcgtcggcatataaattggcgcgcctgacggcggcttccatcccttctgctgcttttgcatccgtccgagccacgacaacgagcgaaggggcggtttcttttatcgctctaatttttgcgatcatgtcctctgcgggtacgagcgtttttccatttaaatgtccgcattttttaggcagttgctgatcttcgatttggacggctgcgactctgctctcagccatttcggcggccgtgcgcgccgcatttaggacaccgccgtagccggtgtcgatatcgaccaaaagcggaagatttgcggctctcacaagttcgcttgctttttcagcgatttcctgggagtgtatcattccgaggtcagggagcccgcggcttgccgtgtaggcggccccggagagatagagcgctttgaagccgatgttttttgcggtaatggcagccattccgtcatgaacaccgggtattttcaaaatatcaggtgctttcatcagttttctgaatgcattggccagctcttcctgagttgattgtttcgagacaatccacatattcaaaacctcctaaatgacaaacaattccatgaaatccggtacaggtgtaccgcttaatctgtgaggatcattcagcagggcgttgattcgttccgcttgccccgccggaaagcgcgtttttaaattattgataaatttgtcttttaagagcgggatgccctcgttgcggcggcgccgatgaccaatcgggtattcgaccgcgattttttccgagtgtgtgccgtctttataaaacacttgaacagcgttggcgatcgagcgtttttccgggtcgagataatcgacggaatactgtttgttttcgactgtcgtcattttttcgcgcagcctgtcgatctccggattttgcgcggtttcgtcttcataatggtcagcggtaatatcgccgtagatcagtccgatcgctgttatatactgaaggcagtgatcacggtcagccggattgtgtaattctcccgttttgtcgataatccggatggccgattcgtgcgtcgtgatcacgatttggccgatgtcatcaagtctgtccttcacttcagggtgaagcctgatcgcggcttcagcagccgtttgagcgtggaattcagccggatacgaaattttaaaaaggacattttcgatgacataagagtcgagcggtctggcgagcgtcaattcttttcctccgaataagacatcctgaaaaccccacattggagcagacaaagcggttttatatcccatttcgcctttcaaggtcatcatcgcgagcctcacgccgcggctagtcgcatcaccggctgcccaggacttacgcgagccggtattcggagcatggcggtacgtccgcaggcttgaattatcgacccaggcctgggagacggcattgataacatcctgttttgtgccccccaatagtgagcatgccacagcagtggaggcgacttttacgaatagcacatggtcaagcccgtttctgtttaagctgttgtcgagagcaaggacgccttggatttcatgagccttaacaattgccgtcaggacatcgttaatcgtgagcggttccttgcccgccgcgagcagctgcctgctgacatagtcggcgcaggctaaaatcgctccgaggttatctgacggatggccccattcggccgcaagccatgtgtcgttataatcgagccagcggatcatgcagccgatattaaaggcgccgtgaacaggatcaagctcaaattgcgttcccgggacgcgggtgccgttcgggacgacggtacccggggcaatcgggccgagatgcttggcgcattccggatatttgagcgccaatattccgcagcccagtgtatccattaagacgtaacgggcggtttcaatcgcttcttcgcttgaaatcttggcatttaccgtatagtcggcgatctcttccagcaattgatcacagttttggagcgtttgactttcagttttcataacatctatctcccttctttctgaatcaaagcgaattatggatgaagatgacgcggtcccgtatagtgaactctcgggcggaacagcctgttgtcttcatgctgttcaatgacatgcgcgctaagaccgaccgaccgtgccgcgaaaaatatcggagtatagagatcgatcggtatgccgagcaggtaatagactggagccgcatagtagtcgaggttcggatacaggcctttttcttcgcgcatcagcttttcgccggcatcgcacatctcatataaatcctgtctgccggttttatgagaaagcgaatagagcgcctttttcagcaaggctgcgcgcgggtccatttttctcatatagacgcggtgcccaaagcccatgattttttcttttctgcttaacttatgttcaatcagcttgcagaagcccgattttgtttctccttcgagcagcatgtacatgaccgcttcattcgcaccgccgtgcaaatgtccttttagcgatgctgcagcgcctgtgaaagcaccgtatatatctgtgtttgtcgatgcgatgactcttgcggcaaatgtggagttcggcatttcgtgctcgctgtaaagcattaatgtctgatcaaagacggctgtttcttggggagtcggttctttttccgtcagcatatataaaaagttctggctgaatgaaagctgtttgtcaggcgtgatgacgtttttctggtgaaggatgcggtagctgttggcggtaatattcggaacctgtgcgatcaagcgcagcgctttgcttctgtttgctgcttgagatctgtcattcaattcgggatcatatcctgctaaagcggaaatcccggttcggagcgcatccatcggatgggtattattcggaagcgacttcagaatagtatagattccgccgggcagttcatacgcactttttaaagcgctttcaattcctttcaattccattggatctggcagcttatcttgaaggagaagatagacgaggtcaagatatgttttttgttctgcaagttcgattaaatcatagcctttaatgacgatttgttccgcttccgtatctaagaaagaaatgttcgtttctccagcaataacgccttctaatcccggtttaaatacaccttgtttgcccatttttccacctcttattcgttttttaacatttgtgtcaaaaacgtgctgtgagaatggcattggctgttcggcggattagtatgaacgttcgagcgtttcttcaattgaacgtaagcttcgtttaatgtgggaacgcatggcggcttctgccaaaacgctgtttttttctttgacggcattaaaaatatccaagtgttcattgaaagatacagacggtttgtagtcaggatttttgtatccgctgattctgcgataccgttcaatcctgctttcaagctgatccagaaaacgttttgcggttgcatttgtgctgatggcgtgcaagatagaatgaaattctgatccgtatttgaccgtatctgttttgcggccctttacggcagccagcttcatcagttcgatgcggtcttcaagctgatgaaggctctccggcgtcaccagctgtgcggcttcggcagtgagtagtccttcaagcgcttcacgcactttaaaaacctctttcgcttcagcgagcgaaatcgggcatacgcgaagccggccgttcggctgtttactgaccaatccttcaagctccagccggtaaagagcctggcgaagaggagttctgctgatgtttaaaccctttgcaagactgtcttcagcaagctgttcagagggaggatattcaagttcgatgattttcgttcttaattcgttataagcgtaatcacttgcagactgtcttttgactggatttgaagagtgcatgaaaaaagctttcgcctccttttttcagaatataattattattgtatacaataatacagatatgtcaatgtcatccactgaagaccaataaatcatctcattcatcattgccttcatttctggcatctcgtctgtcgaaaatggtaaaatatatcacaatcgacaaagaggcgatttgctttttagcaaaaaggagtccaacaaaaatgaatccagctcacgaacctctcccgctcgaattttacaacaagccaacaattgaacttgccaggtccctgttgggctgtcttctcgttaaagaaacggaagaagggcctgcttcaggatatattgtggagacagaggcttataaagggccaggggacagagcagctcacagctatggcaaccgccggacaaagcgcaccgaaatcatgtatcgtgaagccggcgtggtgtatacgtacaccatgcatacccacacactcatcaatgttgtaagcggaggagccgatgaacctgaggccgtgctgatcagagcgcttgaacctcatgaaggcctcgcgctgatggagaagcgaaggagcggaaagaaaccgcgcgattggacaaacggtccgggaaagctgacaaaggcgctttccatcacgatgaacgattacggcagaccgctgacggggccgccgctttatatcgcaaaagggtatgaaccccaagatattttgagcggtccgcgaattggcattgacaactcaggtgaagcgagggaatacccttggcgattctggataaaagggaaccgctatgtctcaagatagttaaaaggtttggctcccgttcatcagggaaaacagtaaaaaaacaggagggagtcaagccatgaaaaaaatgattaaaagcgccgtcaaatgggcgcctgtcatctatccgatcgcatggaaaatcattaaaaaccgaagggagaaaaagaatctgaaagccggttaaaccggcttttttcttggagaaaggccaaattgacttgaaagcgcagtcataatagaatttacttaactatgagacaaatttcacaaaaaaaatgaatatacctgagtgtataggtttgttctcggttcaagtatcttagtgggagggtctttttctatgctcaatgctcggcttaagcttatcctcggcgaattgataggggcagaatcaccattaaccagcgcatatttggccaatgagctaaatgtgacctctcggacgatcagatcagatgtgaaagaattagaccggcttctctccaaaaacggcgctgccgtccaatcgatcaggggtgcaggctatcggctctccatcaagaatgaccgcctctttcgccagcttctgcagcacacatttcatcaagagctttctactcccgtttttccaaatgagcgtattctctatttattaaaaaggcttctcttaactgaggagtatgtcaaacttgaagatttagccgctgagatgtatatcagcaaatcgacggtccaaaacgatatgagagatgtgaagaaaaggcttaaaccttacgacattgagctgaagatcaagccgaattacggctttaagctgaagggagatgagatgaagctgcgatcgtgcatcgcagagcacctttttccaaagcgggaaacggatattgatattatgaacacccggatatccattctcccaaaagaagagcttgctatgatccgtcaaacgattttagaaaaaataagcgaagatcaaatttctctttcagatatcggactaaacaatcttctcatccacgtcgccattgcatgcaaacgcatccgaagcggcaaacatgtttctctttattccaaagatgtaaaggagattatgaatcataaagaatatgaagtggcgagggcgattgtccgcactcttgaacaaaagctgcacgtggcgtttccagaaaaagaaacggcctacatcgccatccatttgcttggcgcgaaaaggacggttatggccgccattcgcagcggtgcaatcgaaagcatgatggatgaagagacagaccggctgacgcaattgatcatgaaaaccatcgatcaaaaattcaccctcggcattggggatgacaaagaattaaaaatcggtctcggccttcacctaaaaccggctttgaatcgctgcagatacggcatgaatatcagaaatccaatgctggatgcaattaaggccaattatccgctcgcatttgaagcgggtattcaagccggtgaagtcatcaaaagagagacgggatttgacattcaggaaagcgaggtcggctacctcgcgttgcatataggcgcagccatggaaagaagaaacatgaacaggccctcaaaacgctgtatgattgtctgtgcttcaggggccggaagcgccatgctgcttcaggacagactgcgggcaacattcggttcaaagcttgagatccttggaacggttgattactacaagctgaatcaaatgtcgctccatgcactcgactttgttatcagcacaataccgctgtccgatgatcttcccattccggtgattcaagtaaacacaatactgggagggggagatttaacgaaaatagaacaagtgcttgccgaagatgacggaatcgcttcgacttatacgagaaaagagcttgtctttttgcgggaaagtctgtcttcaagagaggatgtccttcgctttctgtgcggaaaagtgacgcaatcagggcttgcagacgcggggcttgaagcctcggtctttgaacgggaggccgttgcgcccacttgcttcggcaatctggttgcgattccgcatccgatgacaccaaaaaccgcttcaactttttgggcggtttgcacgctgcaaaaaccgatagtctgggagaataagagggttcaattcgtctgccttctttgtgtagaaaaggacaatacagcaaatttgcaggagatgtacaaatttttgggccgtgttttagatgacagggcgattgtccgggaactcctgaaatgcaaaacgtacggggagtttatgtccgtctttaaaaaaagcgggccggctcatcgatatgccaaatgaagatgtccccttgtcttttttcctcttcgctgaggaaaatcattaagtgtatatgaaaacgatttcattatatgatgaaactgtaagagagatcagacacgatacgtaaaagggggactatttaacatgaatatcttattagcttgcgccgcaggaatgtcaacgagtctgcttgtgacgaaaatggaaaaaagtgcagaggaacaaggaaaagactataaaatctgggccgtttccggaggagaggttcagaatcatatcgataaagccgacgtattgcttcttggcccgcaagtccgttacatgctcccgcaattaaaaaaattaggagaatcgaaaggtgtacccgtcgatgtcatcaatacggtccattacggaacttgtaatggagctgaagtgttaaaatccgccgaacagcttgccggctcttaaaggaggcggcacaagtgaacaagtttaatgcatttttagaggagaagatcatgccggttgccggcagaattgccgcccagcgccatttgcaggctctcagagacggcattattctgaccatgccattaatcattatcggatcgctgtttctcattttagccaatttgccgattccgggatatccggaattcatggcggggattttcggcgatcaatgggctgagaaattaagctatccggttaatgtcagctttgacattatggcgctgatcgccacgtttggcatcgcctaccgtctggcggagaaatatgatatcgatgccctgtcatcgggcgccattgccgtagcagcttttctgcttgcgaccccctaccagattccgttcacacccgaaggcgcaacagaggaaattttagtgtcaggcggcatcccgatttcattaatgggaagcaaaggtctgtttgtcggcatgctgatcgcgatgttctccactgaggtttaccgctgggtcgttcaaaaggatattgtcgtcaaaatgccggacggcgtaccgccggctgtcagcaaatcatttatcgctctgattccgggattcgccgttatcggctcgatctgggcggcccgccttttaattgaaatgacgccgtttgaaagcctccataatgtcgtcaacgtccttttgggaacgcctctttccgtccttggcggcagtctcggcggaagccttattgccgaaactgtgaaaatgctgctgtggtcctgcggccttcatggagcaaacattgtcggcggagtgatgtcgccgatctggtacggagcgatggacgaaaaccgtctcgctttccaagccggagaagcgctcccgaacatatttacgacgcagttttttgagatttggatcaacatcggcggcagcggcgctactttggctttggtcattacgatgtttcttagggcgcgaagcaagcaaatgaaacagctcggcagactcgccatcggccccgctgtttttaacatcaacgaaccgattatcttcggcatgccgatcgtcatgaacccgatgctgctgatcccgttcatcgtgtcgccgctgctgatgataacggcaacctatattggaatgagcacaggtcttgttgcaaagccggctgggattgccgtgccgtggacgatgccgcccggcttttccggatatttggcaacaggagggaaaatttccggagcggtcatgcagctgatcaatctgttgatctcgtttgtcgtatactatccgttctttagaatgtgggataaacaaaagctgaaagaagagagcgaactggagaccggaacggctgcaagcgatggtcaacaggtcagtgtatagaaaaggggtgccaaaatgtccgaggaattggaacgaacgatatttcaaattatccttcacggaggaaacggcaggagcttttgcatggaagcgatagccgaagccaaaaagggagatttcgcagctgcaaaagaaaagatccgggcggctgacgaagaactgatcagggcgcatcactttcagacagctttgattcaaaatgaagcgaagggtgcgaaaaccgaaccttcactgctcatgattcatgcccaggatcatttaatgaatgcgatgaccatgaaagatttggccgcggagattgtcgagctctatgaaaaaatgaatatccacggaggtgtcaattgatgaaaaaaggattgaaaatcgtaacaattggcggaggttcaagttatacgcccgagcttgtcgagggattaatcaaacggcatgacgagcttccggtcagcgagctctggctcgtcgatataccggaaggggaagaaaaacttaatatcgtcggcacgctggcgaagcgaatggtcgaaaaagcaggcgtcccgatcaaagtccatctgacgctagaccgcagggaggctttaaaagacgctgattttgtcacgacgcaattccgcgtcggcttgctcgaagcgagagcaaaagatgaacgaattcctttaaaatacggggtgatcggtcaggaaacaaatggaccgggcggccttttcaaggggcttcgcaccattccggtcatccttgagattgcaaaagacatcgaagaactgtgccccgacgcgtggcttgtcaattttaccaacccggcaggcatggtgactgaagcgctgctccgctattctaatttgaaaaaagtcgtcgggctctgcaatgtgccgatcggcatgaagatgggggttgcaaaggcgctcgatgttgatgaaagccgcatagacattcaatttgcaggattaaatcatatggtgttcggactcgacgttttccttgacggcgtcagcgtcaaagacaaagtgatcgaagcgatggcagatccagaaaatgcgatgacgatgaaaaatatctccggagaatcgtgggaacccgactttatccgcggccttggcctgattccgtgcggctaccaccgctactactataaaacacaggaaatgcttgaacacgaactggaggcttcaaaaacggaaggaacgcgtgcagaggttgttcagcaagttgaaaaggaattgtttgagctgtataaagatccggagctggcgatcaaaccgccccagcttgaaaagcgcggcggcgcatattacagtgatgccgcctgcaacttgatcagctcgatttacaatgacaagcacgatattcaacctgttaacacgatgaataacggagcgatcgcaagcattcctgatgactccgcagtggaagtcaactgtgtcatgacgaaaaacgggccgaaaccgatcgcggtcggagatttgcctgtcaccgtgagaggtcttgtccagcaaattaaatcgttcgaacgcgttgcggctgaagcggctgttacaggcgattacaacactgcacttgtggccatgacgatcaacccgctcgttccgtccgacaaaattgcgaaacaaatactggacgaaatgcttgaagcgcataaagagcatcttccgcagttttttagatctgtagaagcataggaatagatttgaggttccggtgtgtttgccggaaccttttcattgttggaggcgccgctgcgcccgcctgacccggtgaaactgcggccgtcacattcgtactacatatttgcgctagcttctttttcttttatcagatctgaccgccgggccctggcaagctgagtaaatatgaggatgccgatgcccgcaatgatttcgatgaagccgccgattgcaatcacgtttcccgcgccaagcatttttgcggcatatccgcaggcaattgcccctaaaggaagcgatagatttgtgatcatatggatgactgcaaacacttgaggctggtcatccccttcgacagatgtctggataatcgtgaattcggggacattaatcgagctgatggctgccccgaatgcaaaggcggcgagaaatacgagcggcaggaaagtattcagtcctgcgataaaataagctgcaccttcgagaatgcctgccgtaataaaaaggagtccgtacctgttgatttttacttttgcaaggataaatcccagtaaaaatgctcctcctgccgtcgtcgccttcagcagcgagtggatgaacggcgttccgtttaaatcctcagcaacatataccgcggaaagggcttcccagggtgaagccgccaggttcatgaagatgcaataaatcgcgagcggatataatattttgtggtttttcaccaatgtaaatcctctttttaatctcgcaaaatatgtacctctttgagcaagagacttagactgtgaatgagtccgggtgatgctgtatttgatgcaaagcatgaataggcccgatatgatataaaagataaatgaaaagaccaaagtcgttgcaggaccgataaaagtcagcagcactccgcacaatgtaacggctcccagcctgatgatttctgaagaagactggagaatcgcgttggctttttggatgagattttcgttcacgatctgcggaatcagcgtaattgacgccgggttatatgtcgcgcctgttgccgaatggatgatcatgaggcctaaaacaaaccacatcggtgaaaagccgtttaaatagcaaatcggtatagtaatgacgacggctgcccttgttaaatccgaaaagtacatccagaatttcagggcgcttcttttgactaaaggccctgtaatcggcgccaaaaaggcttcggggagaaaagtgacggcaagaagcagggaagtgccgattgcaccttttccgtcaaagattaaaaaccataaaatagaattgaaggcaaaacagtcagcagagattttgattagcctggagatgaaaaggaacgtgtaattcttttcccagacgctcaattttgtttgatccatcgttcagcgtcctttcttgatttgcgtgttacatcagaacggataatctctcctttccggcatggttattgataattttaacataaagtatataaaatggaatcgttttatgcgggagggattgcaagtcggattgaaaaagaggcaagtagggtggaaacagagcctgccgccggcgaattttacgataagggtgcaagccctcttttttgcaaaagagagcttaaaccgcttagcaggactggcttactttatcaacttcaactgtccagccgaatgtgtcaggcaaagcgcctttttgaataccggtgatcgtttggtagagccttttggcgatttctccagtttgaccgttgttgatcacaaggctttcgtctttccagatcagctcgccgacgggggaaatgacagcggcggttccggtgccgaatgcttcctcaagcaggccgtctttgtgagcctgaaccagttcatcaactgaaatttttctttcggttacggagagtccccattgttttaagagatggatgacggagtttctcgtaatgccttccaaaatgcttccgtttagagccggagtgacaatttcaccgctgattttgaagaagatgttcatgctgcctacttcttcaatgtatttcttttcaactccgtcaagccacagcacttgtgagaagcctttgctttccgcaacttcctgagccttcaggctcgcagcgtagtttccggccgttttcgcattgcctgtaccgcctgccacagcacggacaaattcgctttcaacagcaattttcacagggcggatgccttctttgtaataagatccgaccggcgataaaatgatcagcattttatacatattggatggggcgacgccaaggtacggttctgttgaaataatgaacggacggatataaagggatgtcccctcagcttgaggaatccattccttgtcgatctgaaccagctgcttcagcccttccagaacgatttcaggatcaacccggggaatgcagaggcggtcgttggatttattgagtctctcgaagtttttttcaggtctgaacagaagaactctgccttcgcttgataaataagcttttaatccttcaaaaacggattgtccgtagtggtaaaccattgcagccgggtccatttcaatcggctggtaaggaacgattctcggatcgtgccagccgttttcagccgtatagtccatgataaacatgtggtcggtaaaggtccggccgaattcgagcttgtcagcctctggcttttgcttttttgctgtactgagctgtacgctgatcgtttgttttgtcatattcattctccctgccgtttctagtctttttccaaaaaatatttatcttctattttaaaccttctcttgataatcgcaatagatttcagagaaatttgtaaaatagaatttttggaaacattagaaatttaaaacaggaaaaaaagggactccccagcggggaatccttttttatgatgactttttataaaaagcttcgatctcctgatcgacgtaaacccagcctttccagccaaggtggagcgtatctttcaagaagtacggatcatattcatgattcgttaaatcagcaacttgaaagccctcttgttcgatttcttttttgatctttttatagaaatccgtccggccttttttagggaagccggtatagtcgtaaaatttgccgtggaccggaaccgagatgaacagcggttctgcgccggattctttcaaaacatccatcatgagatggaaatcgtggaactcgacggactcggcatagttcatctttttattatggcctttaagctttttcagcttcggcttcaatttcttataaacgccgtttgagattttaaactcattgttccgggattctttggcgccgaccttttcggccatctgttttaattcatcccacgatttgttttttacatcttgggaaatggtccgcttcggtccgtctccttcaaccatggaataatagatgtcctttttctccagaatgctttggtaagcttttgccggcggcgtcagaagagacagtgccaccttgtcctggtcgagctcggctttaaaaagggctgaaagcagagcgtcatttttcactgcatgaaatttaagcatgcgtttgatgatttttttcttcagcccggaatcgacattttgattgaacacaagatcgtatgcctgcaaagccgagaagttcggcgcaaagtgggcttcgtccgagccgtgtttttgaaaccactgcggagagataatgaaaacgattttcttgccctttaattgatcagactgcgccgcaaagttgatcgcgtgaatcaaggactgtgagccgccttttccgaccaggtaaggcgtgaacccttgattgtttactttaaaatagttagacggatggaatgcatctaaccgggacaattccgatgatccgaaaatcggcagatatttcgggtcttcaagcgctttgccttgaagatacatcccctggaacatcatcgggtttaattctgtagctgaagtttcgacgcgatctttaggaaccagctttgtcagccatgcatttgggatcaagatcgcggtgaaaaaaagtaaaaatgccaagatgattggcccgaataaaaaacgctttttcattatctcaactcattcagctgctttatgatttgatttggcgtgttccatgcatcccggtcaaactctgtaatcggcactgtgatgttaaaatggctttcgaatgcgagcagcaattccaccgtgccgaaggaatcgaggattccctcttcgaatatatcaatatccggattttcctttacgatatcgtcctgacatacctctgctaaaactgaaagtacttcttgattaaaatccattatgaaaatctccttttagtgtattagtttccctgagaaaattaaaaatccaaaacatacaaagtggaaggtcaccacaattgagacggctgtcgtccacttgttgttcggccaccacttgtgcttcttattccatttttcaaagaagttaaagccgaccatgagcagcgcgtgatacagcccgtagacgatgtactgaggggcaaggccgtgccagacgcccatcagaaggaacagcagcacatatccgatattggaaacagccatccggtttgtgatccattttttcttcgtcatccaaaggacaaagcgcatgaagacgtagtctctgaaccagaaggaaagcgacatatgccagcggttccagaaatctttaatattgcggctgatgaacggcttattaaagttttcaggggatttgattcccatgatatagctgacgccgaccgcaaaagccgtgtatccggcgaagtcaaaaaacagataaaggctgtacgcatacatgtatgccaatccatgcgagaagctgccggaagtcaaaaacggcagtttcattatgacatacgtattaatgcagtagccgataatgaatttgtacaaaaagccgagaaaaattttattgattcctttgtaaagcagttcttcgtattgctcctttgtccaaaccgtctgatcgtctttttcaaaacggcggtacctgtcgatcggacctgacgagatggttggaaaaaagagaataaagtaaagcagtctgctgattgggagctgctttttaatgagaccgtcgcgggtttcaatgatgagctgaacccctttaaaagttaaatacgagattccgagaaatgttgcccagttgtcaacggcgaaaaacggcagcagctttgacagtgccagaggcaggatagaagctgctgcagccagacaaaatacgatgccgctgttcgcttttagacggtaagcgatatagcctttgatcagaaccgtctgccaaagcgtaaacaggcacagcatgatcagcccgtgcaggctgttcgaaaaaataagcgccagaaccagaacggaaaccgccatattatataagcggaagctttttccgttcagtccgagaatgatggtcggcgccagtaaaattcctaatataatgaagaaaagaaatgaaccataaggcgtcatacggttacctcttcttttaatctcttgcggtcgattttaccgtttgctgtcatcggaatctctttttgatacatgaattttctcggaatcatataggccggcagcttgctgcccaaatctttcttaatcgcgctggttaactggtattccttttcgaaatcgtgttcggcaggcacgatcatggcgatcagatactcgattttctcctcgcggtagaatggaataacgactgccgactgcacatatcgggactgattgatttgatattcgatttcttcaagctcaatccggtagccgtgcagtttgatttggaaatcgagtcttccgaggaagaagagctggccgttttctttgtaacctgcgtcaccggtgcggtaagcaggggagccgttgtaagagaaaaacgctttttccgtcagcgctttttcgcctaaatagcctttgctgacgcttgctccggtaattatgatctcgcctttttccccgtcttggacggcttttccgtcttcattgatgattacgatttcggtttcgggcttttcagaaccgacgggaagagaagaatacttgtttaatacgtcgtctgttacttcgatggaagtgacggcaacggtcgcttcggtcgggccgtatgtgttaaaaacacgagcctttggaaatctttctttaagctgtctggcgactgacgcaggaagcgtttctccgcagaacataaacaagctcagctccggaagcagctcttccgaataagacggatccatcaagcacatttgtgcgaatgaaggcgtcgatgtccagacgttgacgttggactgtttcagtgcttcaaacaatagtttcggccgattaatcatgtctttcgtaaccgtccataaggtgcctccggactgcaggcacggataaaggtccattaccgataaatcaaaggaaaacggggcttgatttaagaacacttggccgctttccaccggaaagtcattcgtgatccaatctgtgaagctctgaaggttatcggctgagatttgcacgccttttggatttcccgtgcttccggatgtgtagataatgtaaaaagtatcttccccatgtacccagcgtccgggatctgtctccggcaccccgtctccttcaagaacgcccggttccactacggaaatgagggcatctcccgtgtcaaccgaagtgcctgaattattgagcagaagctcggcttttgaactgttgatgattttcagaatccggtctgccggaatcgatacgtcaactggaatgtacggatgcccggcttttacacaagccaggaaggaaaccgccataaccggtttcatatgtccgtagacaatgatcggagaagcatctgttaaagcttcgctttgaatccttgcggcaaggcgctcagattgtgaccaaagctctccgtatgtcagcttttcttcttcattcacaaaagcaagggtatcgggttgtgtttgcgcgtattttttaattgtttcaatcagtttcattgttttcttctccattaaaagtcattataaatatatgaacctgtatttgctgtatggaatccgtaaattaaaaacagcagcaccagaatgagaaagtaataggaagtgttgagcagccacttcattgttgttttttcatacaacattcttagcttatttaacattgatcttttcctttccgttattgaattgccttaacaacagtataagacgaaaatgttgtataaaagtttcatttgtgggagagtttttatttccgagcgccgtcagccgtcagctcagagcctatcctattataaacattttttgttattgtggaaataaattctttttaaattacaaaaaaacaggctcatatgaaaagcggagcgcctttcgatatgaacctgcagtttttcggaagaaggcttcgtgcgcgaatgaattaatactttacaaaagcggagcccacaatgatcagcaaaataaataatacaacaatcaaagcgaagctattagagtatgacatattctcacctccgaaaagtggtattacagaatatgatagttttatgacttttgaaaggggtataaatttaaaaatgtggaaaatggtaaaccaggctattttttgatctccgctttaagtcgaaactttaccatggaggtacccgtctattaactgaaaaaacgaaacgaaatgatgttataaggagaaaaatacaatggatatggcgatagataagatgataggactgcctgaagcccagatagaagatttgagaaacctgatggaggactggaagaacgaactcctcgtctataaatttgccttggatcaaatggatacgaagttttcgattatcagccaggaatataatttaattcacggccacaacccgattgaacatacgaaatcaagggtgaaaagctttgaaagcctgattaacaagcttgtgcggaagggctgcgatattacgacaaaggccgctaaggagcacatcaatgatatcgccggtctcagaatcgtctgctcgtttttatccgacatttacaatatggttgaagtgctgaaggaacatgaagacatcaaaattttaaaaatgaaggactacattaaaaatccgaagccgaacggatacaggagtcttcacttaattgtagaagtgcccgtttacttgaccaaccgcgtcgagcacgccaaggtggagattcaaatcaggacgatcgcgatggatttctgggcgagcctcgagcataaaatctactacaaattgaacaatgaagtgccgaaccagctcactgatgagctgaaagaagcggctgacatcgcgaactacttggatgaaaagatgcttcatattcgaacaaaagcggatcaataaaaggaagccgggctaaagaaatgcccggctgctatttttttctgccgcttgacccgaagttgtcaatgttgatatcaacatgatatgtaatatcggcttcggtgaaaatctcatcccatttcccttccgctttttcgatacccgaatttcaagacgtccgcccggtatttgccctgcagtttgccgagcgcgctcttaatccacactttcacttgatctccggcaagacgctcgacttctttccgctttttgttttggaaatcatggcccggcgatggcgttcttcttttgtcagcgtactgataagtttttttgaacttttcactatgccagctccgtcaaatgcgtttttcaactaacagaaaagaggaagaacgctcctctgtatcaaaggttatgactgtcatgaatcgaaaaaggaaaacaagaaaatgataagagcacgaggaggtctaaatatgaaatcggatattgaaaaacgtgcggaatgcggtttgcaaaacggaacggaagcaatgatgaaccgggagtcgcaacggcttgatgctgctttatacggggccgtcctcaatgctttcggctgtgatgataggagccgtctgatgagcggggaagcgggggcgggcggtaaagcgggcggagctggcgaaaggctgctgtaccctaagtaaatggccggattgaaaaagaaacgggccctgtttttaacagccgttgcatcagggacgatgctgaatccgctcaactcttcaatgatttctttggcgctgcacagcatccagcatgagtttcacctttcatttgcaaccgtatcgtggctgatttcatctttttatctagccagtgcggtcgcacagcctgtcacaggaaaaattggcgatttaatcggccggaaaaagatgtttttgtcagggcttgttctcgttgccgtatcggcaatcggcgctcctctcgcaccggctttttccgtcttgttgatcatgcgtttgtttcaatcgattgggagcggcgccatttacccttcgggagtgggcctgatcagaagccacattcatgagaagcaggcgtctgcactcagtgtgctgtccattttttcttcggcaatgaccgcctttggaccgaccgtggggggatttttaatcgtactcgggggatggcccgccatcttcctcgtgaactttccatttattttgttcagctttttgctggggatgtacatgttcccgaaagatgagaaaaaagccggcttaaatgtccgcgccgtgatcaagcggcttgatctcaccggaattcttctgtttgcgggcggaatcgttctcctgctggcatttctgctctcattgagcacgggcgagccccgttttgccgaggggatgttcggactcgtcttgcttttgatgtttgtttggtgggagctgagagtgaacagtccgtttattgatatcaggctgttgatcgcacgcaggacgttaacttcggtctatgctcaatttattatgctgaacatctttaactactgtttgttttttggacttccgagttattttcaggatgaaatgcacctttccgttcaaacgagcggtcttttgatgctgttcatgtccgggacgagcgtattgatctcgcctttcgtcgggaaatggattgaccgttcaggagaaacgcagcccgtgttaattggttcttgcttaatggcagcgggcgctatcctgctcacattgttttttgtcgatgcaccgatgttgtggaaagggatcatcctctctttgctcggggtcagctacggcctcggcaatgtcgccctgcaggctgccatgtttacggcaagtccgccggacatcgtcgggacgacttcggggctttttcaaacatgccgctatcttggctcgatcttttcgtccgtcattctgggtctgttgtttggagaagaaataaccgcggggcattttcaggatctggggatggtcatgattgcggttgccatcggcagcattttgatgagcttcagatttatcaagctgatgaaggattgaaaaatggagcgcgagatgcggctccatttttttgctttcttttggagattggaaaagcaaagagacaaaaattaacaaattgatattggttgcttattgattgtttgataataaagataacgaatagctgaaaaggtgatgatacggaagcggtggggaggataggcgctttgggtctatgaaaagaaggaggagcagattttcaatctgctcctttttaaaattactgggcaactgagctgtaagacggttttctgttttccttcttggtgaagttatacacagctgttcccgcgatttgaccggctgttttcagcctgtctttgctgatatgttcaatcgtgtcgtaaggggtgtggtaccaaggctccaaagcgcctgttcccggctctctccaaataaagttggccgagtcgatgccggcttcatggaatgggacatggtcggatgatccgccttgatgtaaaaataatacgtcttttccaaggcttaaagaagcggctttacttagctgccagacgaggtttgccgaaccgtcgggcgtattgatgtacagctgtgaagcattctcccagcttgtcgccaccatatctaagttaaagttggcaacgctccgtttgacttcctgatttgacaatgtgctgacataatggcgcgaaccgaggagtccgatttcttcggctccgaatgtaataaagcgaatttctttgtcggctggcactgtcttcaaaattcgggccagttcaaggacgactgaagtgccggaggcattgtcattggctcccggtgcatatggaacgctgtcataatgcgaagtcacataaacgatgtcaggatttttgacaccttttgctttgcggacgccgattacgttttgcgaggtttgatttttatgagctttcagcttcaggatcgcttcttgttcagaaagcagcttttccccgtcttcctttttgacgccgacaactggaatatcgactttattaccgcttagattcggagtcagagggacaaggctgtcgacgttattataaatgataactccgcttgcgcctgcgtcagcagcgtttttggccttttcatagaatgtcagctctcctctcaaaatgacggcgatttttcctttcgcttcttctgtgaagtcgccgggcaagccgaggccggcatcatagagaggagcggccaagccttctgctgcagtcggggcggaaccggcggcaggccgcgcaggcacgttatttccctgaacggtaagcgttccttccagccggtcaggtatgctgaacttttgtgtgcttactttcagatttgactttttcatctgtgaggcgataaaagcggcgctctttttttcttctgccgtgcctgtcacacgcggcccgatcgtttcgcttaaatggtaaatcgtttgataggcgcggttctcgttgaattttttgctgaatttttcgatatcttttgcgatggctgtttcctgagaggccgcttgagctgcattccccgttccatcggcgaccacgccgcctgcaatgatcgatagcgccaatccgaacatcatcatttttctcttcatacataaacccccttgatggtcttgttttcctgagaagagatattcgcagcagaacgggtgaatcctgcatgcttcagataaatgattcgatagactggtaatttgaagtttaataaaaaaatttttttgtttgataggatggttgacgtgagccttctttctgtttagaatacgtccgaattatcaggatcctgattttgaatcacatatgtgaattttggagggtgtcatgtcagtaaaatccgcggtacgtgttgtacgtatatttgaattgctgtcaaatcatccggatggattaaccgtaaaggaaatcagcaaagaactttcgctgcctcagagcagtacattcaatttggccgctacacttttggatgaaggttaccttcagcaggatgctgtcaagcgttacaggctgggggcaaaattgattcaagttggaaccgctgccatggagtcgatagacatttcatcgcagggcgttccttttttaaaacagctgatggacggcgttcaggaaacggtgtttatggccgttctatccgatgatcagctcgtctacatcgcaaaaatcgataacaacaggtcaatcagaacaaccgcacagcccggctcgcgcaaaccgctttattgcaccgggcttggcaaggcatttttggcattcatgccggaggacaaaagggaagggctgctcgaccgcatggagtttatccggtttaccgggcataccatcactgccagagaagagctggaaaagcagctgcagacatttttggaacagggatatgccgttgacaatgaagaaaatgaagaaggtttgttttgtctggcggcgcctgtctatggtccggatggcgtgatgaaggcggcgatcagcaccgccgggccaaaggagcgcatgctcgcaagaaaggccgttatcgttgagcagctgcttcacacagccggaaaaattacagaaagcattggcggatatagaaagccgctttagcaaaggagagagttctgatggatgttattagcataggagagacaatggcgctgttcactccgaatgaagacggccctctcagatacgcaagaaactatcaggtgagaatagcgggcgcagaaaccaacacgctgatcgggctttcgaagctcgggaaaaaagccggctggattacacggcttggaaaagacgagttcggggcgatgattctttcttctgtcagaggagaaggagtcgatgtgagccaggtgaagctcgatgacgcggcgccgaccggtttgttttttaaagaaaggaaaagcgcggccaaagtcaatgtcttctattacaggacgctttcagcggcgagttttttaaagaaaagcgatattgatgagcaatacattgagaaagcggggcttttatacattacgggaattaccccggctttaagtgaaagcgcttcagatgcggtgttttatgcagtggagctcgccaaaaagcacaataaatgcgttgtatttgatccgaactttcgaaaaaagctctgggacggagagcgggcgcggcagaccatgtttgaacttatcaaacggtctgatatcgtgcttccggggttgagcgaagggcgttttttgttcggcaccgctgattagaaaaaaattgcggaagccatccgcgggctgggggctgaaactgcgatcatcaagcttggttcaaaaggcgcctattatgccggcgggaacgaaagcggatatgcggaaggctatcagattcaggcagcagcggatcccgtgggtgccggagacggctttgcggccggcgtattatcgggtttgattgatcaaattccgctttcagaagctgtcaaacggggctgtgccgtcggcgccatggtagcggcggtaaacggtgatattgaagggctgcctgaccgcgaatcactgtttgcgtttatggaacaatctgatgaagaagatgtcagccgataaaaaaaccgtagagaaagggtggcagaaatagcatgataggattctttgtgacaaagcgtccccagacatttgtttccgcgctttgtttttcttttttcttgtttgctttcggaaccatccgtttccccgctatcgacaagacggcaggcacaagcgtgattgaagcgagaacagccatcagtacactaagtcctgctgtcagccccattgcagacataaaaggaatgttaacgacagtcaatccgcaaagtgctacgataacagtaagtccggcaaaaacgactgcactcccggctgttcctgtagctctcgcaattgattcatttttttgtataccttcgcctaaaaactggcggtgcttcgtaaaaataaataaagcataatcaattccaactgcaaggccaatcattccggctaatgatagactgacggaagcgatatcgaatacttgtgtcccaatcaaaacaagcccaatacttacacctaatccaatcagtgctgttaaaatcggcaaacctgctattaataaagagccaaacgtaatggccaaaacgataaaggccaaaataatgccgacaatttcagagataccgcctatctccatctcagctcctggtacatctccgcttagttcagtttgcaatccttcataatcagccattttcaaactgtcttttaagtgtttgatagagtaatctttaatatcatctgctgatgatttatacttgatatcagcataggcaactgtgccatctttcgcgattgttcctgtcacaaaaggacttgcaatcgagtcaacggaaccatctttatcgatttcctttaacgtattttctattgctttttccgctgacttcgaagtcagtttctccccatcttcagcaccgaaaataacccgtatgctccctttatcaggaccgtggggaaattctttttgaatgacatccatcgctttttccgaaggtgtgtcaggtatggacatatcctcagaaaaacttggttttaacgtgattgcaaggcctatcgaagcaactagcacaacgatccatgcgcatattacttttatgcgattgcgagcaacccatcctcctaatttatataacatttttgacatgataatctcctttcaacacattgcttgatcacattctttctcattgtagtggacaatgaaataaaaaaaacgtacattcgggcatgtacgtttgggcaaattttaatttgatattattagtctaatgtcagaacgcctctttgcatggcaatcgtcactgcttcagttcttgaattcgcgcctaatttattgtaaatggacgttagtctagactttactgttctctcagagacgcccaaatcaaaggcaatcgctttgcttttaagacctttagcaattgcttttagaactatgacttccttttctgtcagctgcgtatcactgctctgcttcttcatccgctccaattggatttcttgcagacgttttaagatatcaggctgcaatagcacgtttcctcttattgctgcgtccatcgtatgaaaaagggtttctgaacttgtatccttcaatagatatcctttcgcccctaattcaattccttcgatcattaagtgatcttcattatacgtagtcaaaataatgatggggatgtcgtgtttttcttttattagtttaatggcttctaacccgctcatctccggcatatacaaatccatgagaataatatccggttttaattcatctgcaaggcgaactgctgctttgccattttccgcctctcctatgatgatgtagtgatcattcgtttcaattaaaagcttcagaccttccctcacgacaagatggtcatcaacgattaaaaccttattcatctggcatctctccctgaattggtacagtgatatcaatttgtgttcctttagatgttgtactctttatattgaattggcctttcattgctctgacgcgttcttctatgccgagaagcccataatgtcctctctttttcttgcctttttcaacatcaaatcctttgccgttatccttgacggttaaatggagcctcctcttatcatcatcccaaatggacactgagatcgtttctgcttcagcatgctttacggcattcgctatgcattctccaatgatgtaataacagttttcagctgttcgaacgtccggcacttggtctaatctgtagtctaaaaagcaagccatgcctgtcgactcttgaaaatgatccattaatgaggtaattctttcttttaaaaaaccgatttcttctgatttgctgcgcagatcgtcaatcgctgaacgtgcatcagctagtgtgcttttcactctattcatagattgttgaacgatttcttttgctctctctgtgttgtctttggcgagatgaacatgaatagcgtccagctgcatatttaaactgaccagcccctgagcaagcgtatcgtgcaagtcccgggccatacgctgtctctcgttttgcagcgtcagctgttctacctgctgatgagccagctccagcctttcaagagtcagctgcgcttttgtcttttcatcgacttgggcaaaaaatgtagcggcatatgtgataatcacgatcataataggtactgctatgacaagaaaatgcaaatattcacctttgtgaatatgatatagtacagtgattgacagcagaagcaataaataaaggatgaggaacgtctttcttctgtctgccattcctataatctgtccgatcaaaaatgcataaaggccaatgatgatcagcactaaaaagcctgacatgacattagcaagtgtaaaagtgatcaaaccttgtaatacgaagtacagaatcacccttttcttaacccagcgatatgagtgccaatgcaacaaagcaaagatggcggtcaataccgtaaacacattaagcaataaaatggaccagctcccattaagaaattgcagcacgatagaggcgacatagatcatgagaataaaagccaggcccggcactctgagtgcaagcatatttaatgcccgcctatcatgtgagtagtatttttctttgaaaggattccttatcagcaaacctcatccacttcctttaacagtttaaccaaaaagagacttatgaaaatcgatcccatttcattgaacgtgcaacatatatttatccaatcattttataggaagagaaggaacacaacaataccaatgtgcagtgaaccattagatcttcccaacatatgaacattgcccaaacgtacatatgcattctgcctttatgtacgttttatctttccaaatttacatttaaaataatgaggaactcactattgattaaaggaatgatcaacattgaaatcgattgatctcacaattttatcattaaaaagaaaaggaatccgaactgagaaagtgtcaaaaaatcagtgccctgatcgattaagcaatgcgaacgaaaaaacagacaagcatagatacaaaaatcgtcaatccaagaacaagcgtaaagaaaaagaggaatgaagatgtattggttcttaggtgctttattatattttctcgtcggtacttgtattttcattggagtcattagaggcagtcactcaggctcatggatactccttgcattagcagctccgcttatcattgttggctatccttacttttatttaaagcagcatcttgctaaaagatagcaaaatagacgctatacaatctgaggatcttgcatgatccttttttttttcggcctatcaacggtgtttatttttcgaaaaaagggaatagaacaaaaaaagaaaaggagatggacgacatatgaaaagcgaccgaaccatgcatattatttcttgtacagacaataactacgcacagcatttaagcgtgatgttctcatcattgctgacgaatatggatcagacgcgcgaggtgaaactgtatgtcatcgacggagggattgaaccggagaataaaaagcgtctggaagagacgaccctccaattcggagctcctattacatttcttaatgtggaaaaaagccagtatgacaaagcggtcgaaagcagccatattacaaaagcggcttactatcgaatttccattcccgatctgattgatgacgaatccgttaaacgaatgatctatgtcgactgcgacgccttagttttagaggatatatcgaagctgtgggacatggacatttcaccttatttcgcggcggcggttgaagatgcaggccagcatgaacggctgaaaaagatgaacatcagcgatgaagcaaaatattttaactcgggcttaatgatcatcgatatggaagcttggagaaaaaacgacatttcgaaaaaagtcatcgactttatcaataacaacgatgaagacatgtttgtgtttcatgaccaagacgcattgaacgcgattctttatgatcagtggctcgaacttcatccgaggtggaacgcccaaacacacattattttaaaagaaaaaacaccggcttccctcatcgatcaaaagcgctatatggaaacaagggcaaacccggcaatcgttcatttctgcggcggaaacaagccttggaattcaaacacctcacacccgtacgcccgtcaatattttaagtatttgcagtccacagcctttaaccagccggccaaattgtctaaaaaccatgtcagctaacatgccaatctcattttaaatcgcaggatgaatcgatataatgacaacaaaccctgacgtatccccatattcgcttgtttccttcggaaacaagcatttttctggtcgggaaaattcctgctgaatggaggagagcttttggttaaagtgctgttgacgctcaacggactgttttaccgcgctgcgccgcgcttgagagaaagggtcgaacggctcggcgccgaatttgcgtttttggattcaaatcggttgacgagacaggatttactgactcatatcaaggatgtccatatttatatcgccggcgttgaaaaagcggaccgggagctgatcgacgccgctccgggactccggtatatcatgaaattcggcgcgggaatcgacaatattgatgtggaatatgcaaacgaaaaagggattctcgtcacgaatgcacccggccaaaatgcctcggcggtcgccgatttggcattcggtcttctgctgtctggcgcccgttcgatcccgcagtcaaacgcggcagtcaaagcgggcttatggcaagcggcgatgggctatgagctcgatggaaaaacgctggggcttatcggttttggggaaatcggcaaaaaggttgcaaggcgggctgccgggtttaatatgaacgttttggcgtacggcacatacaaagactacaatgcagccaaacggctgaatgtgcggttcgccgagcttgacgatctcctggaaaaatcggactttgtatgtatcagcacatcattgagacctgccacctatcatttaatcaatcaagaaaaactggcaaaaatgaagaaaaccgcgtacctgatcaacattgcccgcggagaagtggtggacgaaagcgcgcttattcaagcgcttgagcaaaaacagatcagaggcgcagcattggacgtctttgaaaccgaaccgccggctgcccggatcgccggtctcagcaatgtcatttgcacggcgcatatcggcggcgctacgtatgagagcatcaggcgcatcgaagagatgacatatcaaaacatcaaaaggtttatcgaaaaacagcagccggctttccgcgttcaataaaaaccggaaacggcgataagccgcgtccggttatgttctttgaaaaaactcgaccatttctccttcgggcccaaaaagaaaaaaatagcggaagccgttcggcaatacggtaatctcatcttccatcagcttgatgccggcgccttttacgcgatcaaattcagcctcgatatcatcggtcgagacggcaaaatgatgaacttttccttcctgaggaaggttgtcgttatatccctcgatcagttcgagctctgtctcgtctctgttctcaaagcctaaaaaagcgagtttcatgacgccgtttgtatgggtcattctgcctttcagcgtcattccgatcacattctggtagaatgcgatcgaagcatcaatgtctttcaccatcagtcctacgtggtcaattcgcgccatttcgccattcctcctttagtttctccatcatcttagaaaaatcggaatcatctgtcaattatatcgattacatgatgaataagaacatctatcaggcgttatggtaggatagagaagactttaagataaggactgaattaaaatgcatacattaaaaataaaacatccattcgctgcaaaaatgaaaaagggctatcccctaatcgaaaaagaggccgtttcttcgcaagaaaacggcataaaagaaggatcgctgatcaggataaccgatgaaaacggcaggtttttaggaaagggctattatggcgagcaaaacaaagggatcggctggattctgactcgaaacgagggggaatcgattgaccagtcattctttttaagcaggctggcgaaagcatttcaagccagaaaatcgctttttcaagacccggatacaaccgcttttcgtttgtttaacggggaaggcgacggaatcggcggctttacgattgactattatgacggctactatttgttccaatggtacagcaaagggatttatacgcttaaagaaacgattatggaagcccttgatgaattgacggattataaagctgtttatgagaaaaaacggtttaatacggccgggcagtatgtggaagatgacgactttgtcaaaggcgaaagaggagactttccgatcattgtgaaagagaacggcattcattttgccgtttacctcaatgacggagcgatgaccggcgtttttctcgatcagcgccatgtccgcaaggcggttagggaccggtatgcggaagggaaaaccgcgctcaacacattctcatataccggcgcattttctgtggcggcggcgctcggaggcgctgaaaaaacgacgagcgttgatgttgcaaaccgcagcttaagcaggacgatcgaacaattcagtgtgaacgggctggactatgaagctcatgagattaaagtcatggacgtttttaaatattttcaatacgcggccaaaaaagaactcgcctttgaccttgtcatccttgatcccccttcatttgcgagaacgaaaaagcatacattcagcgcggcaaaggattacaaaaatctgttaaaagacgcgattcgaatcactaaagatcaaggtgtgatcgtcgcttcgacgaacagcagcgcatttggaatgaaaaaattcaaaggctttatcgaagaggcatgcaaagaaacggggacgcgctttacagtgcttgaggagcattcgcttcccgaagattttaaaacggtgaaaagctatcctgagggcgattatttaaaagttgtctttttacaggttcgccatcgttaatgtaaggctggagaaaaaatttgcgataaaaacaatacctgtcggtcaattattcatgtatattgatattacgcaaatcacacaggcagggggaagctatgaattacggaattttaatatcgataggtatttatatggcgggaatgcttttcatcggatattttgcatatcgcaggacatcaaatttgaccgattacatgcttggcggaagaaatctgggtcccgccgttaccgcgttaagcgcaggagcttccgatatgagcggctggctattaatggggctgcccggtgcgatgttcctgaacggattgagcagcggctggatcgttgtcggtctgacaatcggcgcttatttgaactgggtgtatgtcgcgccgaggctaaggacgtatacggaaacggccggcaacagcattactatacccgattatttcgaaaaccgttttaaagacggttcaagactgttacggatgacgtcggcttttgttattttagtatttttcactttttatacatcatccggaatggtggcgggcggagagctgttcagaaccgcattccacctggattatcggatcggcatctggctgacggccggggttgtcattctttatacgctcttcggaggctttttggctgtcagctggaccgattttgttcaagggacgatcatgtttatcgcgctcatcttaatgccggtagtcgtgtttgttcaactggggggaattgcgccggcgttttcggaagtgaacgcggttaacccggatctcctccgtccgtttcaaggaacaaccgtaatcggtatcatatctttactggcatggggtctcggctactttggacagcctcatattattgtcaggtttatggcgatttcaagcgtgaaagaattgaagagtgccagaagaatcggcatgggctggatgatcttttcgatttgcggagcgatgctgacaggactcgtcggcattgcctatttcagtgcgaatcatcttacgttaaagaatgccgagacgatattcattaagcttgccgaccttttgttcccttcaatgattacggggttcttgctggccgccatattagcagcggtgatgagcacaatttcttcacagcttcttgtaacctcaagcgcgctgacagaggatttttataaagcgtttatccggaaaggggcttctgataaagaacttgtacttgtcggaaggctgtctgtcctcgccatttcactgatcgcactcttgatggcgcttcatccgaatgaaacgattctgaatcttgtcggctatgcatgggcaggcttcggggcggcatttggccctgtcgttttgctgagcctgtattggaaacgaatgacgaagtggggcgcgcttgcagggatgctgtccggagcgctgaccgttattgtgtgggagcaagtgaaagcgtttgacccggtttatgaaatcattcccggatttattgtttgtacagtcgtgatcatcgccgtcagcctgatgacaaagaagccgcgggcagagattgaaaaggaatttgagactgcggttgaacagctgaaaggttgagaatctagtgatggcctttgtcaaagtattgttgacgaccgcttttctcacaggggctttcgcaggattcctgtgggcattttccaaagaaaaaggcgatggatttttctcggaaatggcggcggatggatcgggagtcttcacacttttcggtttgatcggtttactgaacgtcaaactgttaaaagcaatttccccaaaactgctgcatgacaggtcttttaggtgtatttcttttattctggccgttgtattattgatgatgtctatattcatatggctgatcgatttctaaatgaaaaaaccaaattggcggaaaaaccttcaccaatttggttttttttcggctattacactgcaataagggaaatcagaaacggcgctgcgcaaagcgtgatgatcgcggccaggatcatcgacacgcttgagatcgttccggacacggagctcagctcaaatgcttttgacgtacctgcgccgtgggcgcttgtgccaagcagtacgcccctcgcgatttcattatcaatccggaagtagcgaatgaccatcggtccgatcactgatccgaacaaggcggtcaatatgacaaaaacagcggtcaccgccggcattccgccgatcatttcagaaacgttcattgcaattggcgttgtgacagatctgggaacgaggctctcgatcaggtcttcattcagcttgaagagttttgcgataaacgctgttgacaggatcgcgatacagcagcctacagccacgttgataatgatctcaaccgcgtattttttcaagactggaaagtatttgtacagcggaatcgcaaaagccacggttgccggctggagcatgtccgtcaacaagcgtccgcccgcattgtacgcttcaaaagggacgttgatgaaaagcagcaggccgaccagtatcaccggcgtgaccaataaaggtgacgcatacacctttggatggcgtgaatacaccgcttttgcgcccaaatagattaaaactgttgcgatcaggcttaagcatccgatgagcatgttttttttctttcctttcttttggcaatcaattgagtcagcattccggtcgacaccatgacgacgaatgtactgatgaggacaacgagtataatgcttgtgccgaattcagccagaatatctccgtagttcataatcccgacggctgaagggacgaagaacaaaagcagctccgcgagaagccacagcgcgccgatttcaatccattccagcttaatgattttgaaatggagaagcgcaaaaatgacgataatcccgagaatgctgccgggaatgtttatatgaagaacctcgacaatcagattcatgaaacgggcgaataaaaacaaaagagcgacctgacctaatcctttaatgaatgttttcatgtcattatccccctttctaaacaagagtgtacatgagtttcaagtataggtaaaatacatatacagaatatatattattcattttgtctatagttaaaagcgcaaatcaggtcaaaagcaacagtttaataactaaaattggaaaacgtcatacggaatcatttggcgattttttgtgaccattaaaccgccgtgttcccgtgcctttagacttgtccgcaatgaaagcggtgtacagatgattcaaaaagacgggttatatgtccttgaaatgcggtgtgaggatgatggcgaactgtgtatatatccctaaaaacagtctttaaagcctattcaacatccgtgattttcgacttaaactataaatattggaaatgagagcaagtctagtcaaagatgtgaatctatgaaaaacaaaccggatcatgatttgacaaggaaataatcaatgcgaatcatactgcaatttcagaggtgacaataatggactactcagacacgctgcaaaaaatacacggtgtcctctcccataaggcggcagagctggaagaacaaattgcaaggctggagcgggcaaagcgcgatgtagagcgggaacaaaacctcggaatcgaagaaatcaggcagattttgcggccgaatcttaatgagtcgtggaccggaagcagggcagccgattttaacgaagcacgtgatgaagcgcacacggcaatgtacagaattttcaccgatgagtatgatcggtatattcataaaatcgatttaaagatatttgctttagatgctgaaaaaggagctgttcaggctgcaagctggtcagccgaccgggcggactttctgatggaaaaaggagaggaagccgtcgacgctctgcacagcacaatcaacggtttaaaaggatggttgaaatgagcaaaacgattaaacttaaccatgcagcggttatgaagaagctggaacaagtaagcagcacgcttcaagccgtatctttaaaaagcccgccagccggagcgctcgggcggaacaaccttgattttacgaaaaagtggcttgaacgagaagccgaaatttgcaatatggtcaaacagtataaagaggctgttcgtaaaaacattgaggacacccgctcaaatgtggacacgctgaaggaacaggatgaggcgattgcccgaagataggcgctgccggctgtatgccggcggcgtttttattgtggctctcgcgggggtgcagaaaacaatgaatttggtttagaatatgaatacacgcaggaactctgaaagggtgtcaaacaaatggacatacgccacttaacctatttcttggaggtagcccgtctgaaaagcttcacaaaagccgctcagtcattatacatatctcagccgacgatttccaaaatgattaaaaaccttgaagaagagctgggcatcgagctgttttaccggcgcggccggcagatcgagctgactgatgcggggcaaagcatgtatgtgcaggcccaggaaatcaccaagtcatttcaaaatttaacttctgagctgaacgacttgatggacgtcaaaaaagggcatgtgaggatcggtctgccgccgatgatcggctccggtttttttccgaaagtgataggggatttcagagataagtatccgaacgtcacctttcagcttgttgaacacgggtctgtgaaagtgcaggagggagtagaggacggatcgcttgatatcggcgttgtcgtcctgcctgcaaaagaggagatttttcactcctttacaattgttaaagaagacttaatgctaatcgtccacccgtcccatcgttttgccgatgcggaagagatcgagcttcggcagttaagcgaagaaccgtttattttcttccgggaagactttgttcttcacgaacggatcattacggcctgcttgaaggcgggatttcagccgaatgtcatttatgaaacctcacaatgggatttcatcagcgaaatggtttccgcgaaccttgggataggtcttttgcccgaaaggatctgccgggatcttgaccctgaaagggtgaggatcattccgctggtgaggccggccattccttggcatgtcgccgtcatttggagaaaagaccgctatctgtcgttcgcggcgagggcgtggattgatcatacaaaatcgtatatatggagcgagaattcaaaaacagaaaggaatgcaggcgaatgaatatggaagatgccgcaaggggaattgagttagtcagaaagcaaaaaccgctcgtacacaatatgacaaacaatgtcgtcaccaactttacggcaaacggtttgctggctctcggcgcatcgccggtgatggcgtatgcgagggaagaggccgccgacatggcaaagatcgccggagcccttgtgctgaacatcggcacgctcagccgtgaatctgttgaagcgatgattattgcaggaaagtcagctaatgaacatggggtgccggttatttttgatccggtcggtgcgggggcgacgccgtttcgaacggaatcggctcaagcgatcatgcgcaaagtgaaggtttctgccgtcagaggcaatgctgcggaaattgccaacacgcttggggaagactggctgatcaaaggcgtggacgcgggtgaagagagcggcgacagaacggagctcgcaaaaaaagccgcgaaattatgggatacagcagtcatcataaccggtgctgaagacgtgataacggatggtacaaaaacgtataccgtgggcaacggacatcagctgcttacgaaagtgacggggacaggctgcttgtttacctctgtcatcggtgcgttttgcgccgttgaaaaagacgtttgccgtgccgctgtatctgcagccgctttttatggaacagcggccgagttggccgcggcgaaaacggaaagccgggggcccggaagtttccaaatcgagtttttgaatcagcttgctgccgttgaagctatggatataaaagaacgcggcaggatcagagaggtggaataagatgacgcgagtctcagaagaagcaatgaaagatctgttgtcggtctattttattatggggtcaaacaataccgcaggggatcctttaactgttattgaaaaagctttaaaaggcggtgcgaccctttttcaattccgcgaaaaaggcgagggtgcgttgaaagccggagatcaaacggcgtttgcccgacaggtgcaggcgctgtgcaaacagttcaatgtaccgtttattatcaacgatgatgtagaactcgcgcttgaacttgacgcagatggcgtgcatatcggccaggatgatgataaggccgcagacgtcagagcgagaatcggggacaaaatcctcggcgtttccgcgcatacacttgaagaagtcttaaaggcggaaaaggatggagcggattacatcggtgcggggcctgtttaccctactgaaacaaagcgggatacaaaagctgtgcagggcgtctcgctcattcaagagatccgcaggcagggaattggcattcctgtggtcggaatcggcgggatcacggtcgaaaactgcgtccccgtcatcgaggccggggcggacggcatcagtgtcatcagcgccatcagcaaagccgccgatccaaagcaggccgccgaggcgtttagcgagaaagtccaagctgccaaacaaagcgcacattcctaaatggaatatgcgcttttcagcgtgtcgagaaaccctcgcattcgttgtcaggcctgcgcgtcggtgctcacgaattccaacattcgctccgctccgatgctcgaccttcctagactgcaagggttttcaatcacgctgaaaggatgataaaatctgcaaaacgcacattcctaaatggaatatgcgcttttttatatgaagattaaaatctctcgttcataaaccgttccagaaaacgttcggttacaagggaggacatcccaagcgctgaggcggtgcggccgagcgtggagatttttaaatgataattagacaaggcttctgctgcgcttcttgaggcaatcgtttttttgatcgcatcgacgatgctcggataggattccactatggtattccgcaagataatggtgtcgggattcaacgttttcaagatgttgagaagcccgatgccgatatgaaagccaaagcgttcaaacgtctccatcatgcccggatcaccgcggtctgcaagttctttaacggtttcgtaaagctgggccccggaattcgctgcatagtgagagaagacggctttttctgaagcgtaaagctcccagcagcctctatttccgcaccggcataacggaccgtcaaagtgaatggacatgtgcccggcttctccggaaaaaccttgcacacctctaaacaattttccattcattaaaatccctaaaccgatcccggtattaatgctgacaaacacggcatgctcaagctggccgccttccccgtattccttctcgccaacggcgccggcgttggcttcgttttcaattaaaatgggaacgccgaacctttcttccagtttttcttttatcggaatcaaatggatcggcttatttggcgtaaagactacatgccgttcgttgtccaccaagccgggcacgcacacgccgattccggtcaatccgaatggggaaggcggtattttgtcaacggcaagccccgtcaattcgattaatgcctcttctgtcgcctgaatgtcttcttcatcaagcgttcgttcgaattgttcaatcaaatgcccttcaaggtcggttaacgcaacaattatataattggttccgacatctacaccgaccgcatagccggcttttcgattgaatttcagcataacgggccttctgccgccgcttgactcgccggggccggtttcataaatgatgtccttttgaagcagggaagacacttgggaggaaacggtcgctttatttaatcctgttatttccgaaagtttggcccttgagacgggtccgttttcaataatctgctcaaaaatcagggctttgttcattttttttacaagggcttgatccgctgtattcaatgtcaatcactccattgctttgaagctgtgaatttattatagtataacaaattttgaaaacttattttttcctctatttccattgaaagcgattaattgatcctgtaaaatacatacaaggaagttagtttaatggttaaacaaacattgttttttaacgtttgcaaggaaaagtgaagggggagatcggaatgttttttagaaatatcggaatgattgagtatgaaggggccgattcggaaaatccttacgcatttaaatattacaaccctgatgaatttgtcggcggcaaaacgatgaaggaacaccttcgcttcgctgttgcgtattggcatacctttgatgcggacgggaaagaccctttcggcgacgggacgatgttccgggcgtggaaccggctgacacatcctttggataaagcgaaagccagggcggaagcggcttttgaattttttgaaaagctcggcgtgccctatttctgttttcatgatgttgatattgtcgatgaaggagcaacattgcgtgaaactttcacgtatttggatcaaatgtcgtcttttctcaaagaaatgatggagacaagccatgttcagctgctttggaatacagccaatatgtttacgcatccgagatatgtccacggggccgcaacttcttgcaatgcagacgtctatgcctatgcagctgcaaaagtgaaaaaaggcctggacatcgccaaagagcttggagcggaaaactatgtgttctggggcggaagagaaggttatgaaacattgctgaatacagatatgaagcttgagctcgaaaacttggcttcattttatagaatggcagttgagtatgcgcgtgaaatcggttttgacggccaatttttaatcgagccgaagccgaaggagccgacgaagcaccaatacgattttgatgcagccacaacgatcgcttttttagaaacttacggtttaaaagaccattttaaacttaatcttgaggcgaaccatgcgacattggccgggcatacatttgagcatgaactaagggtggctgccttgcacgatatgctgggttccattgatgccaaccagggcgatttgctcttgggctgggataccgatgagtttccgaccgatctgtattctgcggttctggcgatgtatgaaattttgaaagcaggcgggtttaaaaccggcggcatcaacttcgatgctaaagtaaggcgcccgtcatttgccgatgaggacttgtttcacgctcatatcgcaggaatggatacgtatgcagtcggcttgaaagtcgcctcccgtctgcttgaagataaagcgctcgatcaggttatcgaagaacgttatgagagctatacgaaaggcatcgggcttgaaatcaaagaaggccgcaccgatctgaaaaagctcgccgcttacgctcttgaaaacgaccatattgaaaatcagtcaggccgccaagaacggctgaaggcgaccgttaaccgttacttattgaacgctttgcgcgaagcgccggcaggaaaggagacacgctagtggaatacgtaatcggggtcgatctcggcaccagcgcggttaaaatcatccttgtcaatcagcggggagagctgtgcggcgaggtctccaaaccgttttccatcattgagccccattccggttattccgaacaggatcccgcagaatgggcggacaaaacgaaggaagccattaaggaattggtcgggcatttcccgggaaaagcatctcagattaaaggggtcagcttttccggacagatgcatggattggtacttttaaacggcaaaggagaggttttgcgaaacgcgatcctgtggaacgatacacggacaaccgaacaatgccggctgattaacgacaaaatcggaaaggagcgcctgctcgagatcgcgaaaaatccggcgctcgaaggttttacccttccgaagcttttatgggtgaaagaatatgaaaaagagctgtttgaaaaggcggccgtttttttgctgccgaaagactatgtcaggtacaccatgacggggcgtcttcacagcgaatattcagatgcggccggaacgctcctgctagatgtgagacatcaaacatggagcggggaaatctgcagaaagctcggcatcccggagtccttatgtccggatttgattgaaccgggcgcttgtgtcggcggcctcagaccggaattcgcggccgaaaccgggctgtctcctgaagtcaaggtgtttgccggcggcgctgataatgcatgcggcgctgtcggcgccggtattttaaaagaaggaaccgccctttgcagcataggcacctcgggggttgttctcacatatgaatcaaaccgtgatcaagagtttaatggcaatattcattttctgaaccatgcagcccccgatgcgttttattcgatgggagtgacgctttctgcaggacgcagcttcagctggtttaaagatgtatttgccgggcaggcgtcatttgacgaattaatcagcgatattggccattcccgtcccggggccgggggactgctgtttaccccttacttgtcaggggagagaactcctcatgccgacgcagatattcgcgccagcttcatcgggatggacagcgcacatacacgggcggactttgtcagagccgttattgaaggcattacattctcccttcatgaaagcattgaacaattccgtgccgggggaaaagacatcagccgtgtgatttcaatcggaggaggcgccaaaagcaatcaatggctgcaaatccaggcggatatcttcaacgccgacatcatcagactgacaagcgaacaggggccggcatacggtgcagccatgattgcggccgtcgggtgcggctggtttccgtcgcttgaggcttgtgcagaccgattcgttctcatcaaagaaaccttttcgccccgccgtgaatacagcagacaatacgaagctctctttcaaatttacagagatgtctaccggcacacgaaaacgctgaacgagcggctggcaagctttcgggaataaataaaaacttatgggccggccggctcataagtttttttcggctgcacacggtttaagattgatccatgtggatgcctgtatgcgctttgacctgaatttctgcaaacgcgtcttgaccaggggtttttgaagatagaatcgttccaagataagcgcctaaaaagccgagcggaatagagatgattcccgggttggaaagcgggatgagcgggtctccaacaaagatggcgtttccggccgggtcccatacgctcgggctgatggagacaaggatcagagcgcttaaaaggccggtcaggctgccggccaaagcgccggcggcattgaatcttttccagaagacggtgaagataatgagcggcaaattggcgcttgccgccacggcaaatgcaagcgagacaagaaacgcgacattcagcgattgggcaaagacagcaagcagaattgaaaggacggatacgccgatggaagcccaccttgcagcaatcatttgctctttttccgtagccgcgccttttctgataatctggctgtatatatcatgcgcaaaagcagaagccgccgacaggacaagtcctgtaactaccgccaaaatcgtggcgaaagcgatggctgagacgaaggcgaacagaaaatctccgccgagcgcctgagcaagcagcggtgcggccatattccccgctttatcggcagctaaaatgttttcaaaaccgacaaaagcggcagcaccaaaaccgagaaagaccgtcataatataaaatataccgataatccatgttgccgagacaaccgatttccttgccgttttggcatcttttactgtataaaagcggatgagaatgtggggcaggccggctgttccaaggacgagcgccaaattgagtgaaagtgtttcaagaggaactttatacttattgccggggtttagaaaatccgccccgagcggagtagctgttttcatttgttcgaacatgttcgtcaggctgaagccgaattttgaaaaaacgatgaccgaaatgatgagcgtccccgccatcaaaagaacggccttgatgatctggacccagctggttgcaatcattcctccgaatacgacgtagatggtcatcaaaaccccgacaatgcacactgccagcgtataatcgatgccgagcagaagcttgatcagcgcgccggcgccgactaactgtgcaatcatataaaaggtggagatcgtgattgtgtttaatgcggcgacaccgcgaattttcttttgtttaaaacgagaggcaatcatgtccgccattgtaaatttgccgaggtttcggagcggttctgccacaatataaaggacaactaaataagcgacgaggaagccgatgctgtagaagaaaccgtcaaacccgttcaaagcgatcatcccggcaattccgaggaaagaagccgctgacatgtaatctcccgcaatagccagtccgttttgaatgccggtaagtccccctcccgccgtgtaaaactcattggccgtttttgtctgtttagcggcgaaatacgtaatgacaagcgtgagggcgacaatggcaagaaacaaaataaaggctgtggcactcatgaatcaacgcctccaatcttctttttgaaatcgcttgcaatttgatcgaattgaccggcttttttcgtatacacaatgcacagcgtccacgtcataacaaactgagcaatcgcgaaaacccatgcccacgtgatggccccgactgccggctgattcaaaaatgtgaagtatgatgtcataaccggcagcaggaaataaaagagcaaaaagaaaatcgtcatcggtacaataaaagcccgtttccgctttaacaaccgctggaactccggagatgccgcagctttgctgtaatctattttgccttctcccatttgttctttgaccctccttgtgtttgtctgaaaagatacaacaaaggtatgtaacaagctccggatttattcttcaattttcacaaagccttttatttatataagatgaaagacctgatcatctcgaataaatgctttttccataaataaaaccgtttgttcgcctttttatttgccatgcttttgccccgtttccgcctctgccagcttccttctcagttcatttgcagacacaatcgctgtccggtctgtcaccacgccgccgggcttgttccctttgccgagcaaatagccgtcgaatgtcatgttcataaaatcaaagatatattgaaactgttgaataagcggcagccctttcaagcggggatcatcgtctccgacagccgcgacgtagaccgtttttttcgccatttgctgtttaaatgcagatctcccgtgctcaatcaatgtctgtgaccagcggtcaataaagtttttcatcaaacccgacattccgtactaatagatcggagtggcaaaaatcaggatatccttctccagcacccggctgatcaggtctctgtagtcatcatcaggatacaaaggggctgtattgccgtgcctgtagtccgatacgggctcaatgtgatagtttcgcaggtagatcttatcggcatcaagtccgtctactaatcgattcaccaactcttccgtatttccgttttcgcgggagcttccgcagattgctgctatccccatattcatcatcctcctctggaatgggtcatgaattcagtttaagataacaacaaccatcagtaaaattgatattttagatatttaacatcgaaaaaaccgattatataggcggatggttaacagaaaagggagtatggaaaggaagcccgaggatggtatcaaaaggattaaggccaaaagctccgccccctttcaggagaaaggcaatcgaaaccgatacagaagaaagtgtatggggctgctggcatcagcgttggtcagcaatgcctctaaaacgccttaatcaatccggtctggtaccccttaagagagtgaagctggaaaaagtgaaacaacctatgtacagggcaaaaggtaaggctgctccttaaaatgctcgtttctatggagcagacagaatctatacacaggcagcaagcctgctgctcaaatacgtcattatcaattaaaacactcgttaaaacagccggttggatcatcttgatagaccaagattcaacagaaccgcctgtttttttggataactgatgcttttaaacgcttattgctttatctgtttttcagcatcgctttggatgggctgactgcgaagaaattctttcacatcttcaatttgcagcccaagttttttcgcctccttcatcaaaatcacccaatctttgtccaacttgtgtttcgtttgagtattcatagcttcctccaatatgataagacgttgttcacctcaaagaaaaaacggttcttccttgagatgcaataaaagttataaaacaacagccatgtgaaaacaatgacaaatttcataaaaaattcacaaagtcatcattgataaacctacctattccctaaataactgactaaaaaaaccaaaaaatcttagattcttacttataataataaacaatcaattactgactggatagtattcaaataaaaatgatcatttttccctattaagaatttctcaattgcagccgaatatcctttgaatattctaaaaacaaggaagggatttttgagaggtcattgtgtggaaatattggaaaatcgatggtttgaaggggttatttagattaaagatctaatgggtggagagggttctttgggcttagttgctgtatgggttaaagaagggtaatacgaaaatactattatcgatcagcattaagtggaaaaaaagaacattggtttcaaatgcagtgaaaaaagtatagcttttgcctcaaaatcgcgttgattcaccaagagaaaaccattgatatggataaaaacccgaactattccttgtaaggtatttaatggaatgaaggtctctcaattcgtttttcccccaactttttatttgaagaaatgatgaaaaatgcaagccggaaaatgctgaaggtggtaaaatgaaaaaagcaaatatatcatctttgtttgaaaaagagattcacaggcgttttatagattttaaaatagaaggataacgccgctgaaaggagagaaatgaattggcaatattagtatgcggaggggcgggctatattggaagccatgctgtagcggaactgttaagccgcaatgaagatgtcgtaattattgataacctgcaaactggacatgaagaggcggctttaaagggagcttctttctataatggagatctgcgcgatgaagcatttctaagaaaggtgtttcaggaaaacgacattgaggctgtcatgcatttcgcggccgattcattggttggagaaagcgtaacagatcctctcaaatattatgacaacaacgtttacggagctgtttgcctgttaaaggtcatgaaagagttcgatgtgaagcaaattgttttctcatcaaccgctgcaacatacggagaaccggatcgggtgccgattatggaaacagatccgacggatccgacaaacccgtacggggaaacgaagcttgccattgaaaaaatgctgaagtggtctgaaaaggcatacggaatccgtcatgtcgtccttcgctactttaatgttgccggggcgcatgtagacggcttgatcggcgaggaccaccagcctgaaacgcacctgattccgatcattcttcaagtcgcgctaggcaaacgggacaagattatgattttcggcgacgactatccgactccggatggcacgtgcatcagagactacatccatgtgatggatctggtcgacgcgcatattctcgctgtcgagaggcttcgaaacggcggagaaagcgccgtatacaatctcggaaacggaacgggcttctcagtcaaagaagtcgttgaaactgcccggaaagtgacaggctgtccgataccggcggaggttgcagagcgccgcgcaggagacccggcacagctgatcgcctcttcggaaaaagcggtgaaagagcttggatggcagccgaagtacgccgaactggaaacgatcattgacagcgcgtggaagtggtttaaagcacatccgaacggctatcaaagctagaatgcgataacgcctattatataggataaaaaagagctttcagtcacagaagaaagctcttttttgatgttctttagtttaaaaccggttgtcagcagggaaaaggaagggagaaggataatgattcaccatgaaaaaatttaacaatgtgaaattaatgattgaccaaagttttttattgtggtaaacctaaatttgacagattttttgttccggagggatttgtcagcgcttgctatgtgtgtaaaaagaactaaaaaattaccagtctttttcctttgttattcataatatcatgaacaaattttgacgattttgtgacatttgggtgaaaaaaaggtgaacaatcgaaaaaaataaggctaattggtgaagattttgatagcatagcaaggtagaagaaaaaagtttttcagaatccttttatcttagatattctgaccaaattttagacatcattaaggaaggatggtgatcctcttgttcagagcatttaaaccactgattatgctgactctgctttcctccgtttttttattgggcggctgcagtcaaatcgcggtattggatcctaaaggaccggttgcttcgcagcaaagagatcttattctattatcgattggatttatgctgtttatcgtagcggtcgtatttgtcctttttactgtgatgattgtgaaataccgtgagcgtaaagacagaaagtctccttacagcccggaagtagaaggcaatacatttttagaaatcgtctggacagtggttccgattttaattgttattgcgctgtcagtgccgacagttcaaacaatttattctctagaagaggctccaaaagcatcaaaggacaaggaacctttggtcgtatatgctacatctgtcgattggaaatgggtattcagctatccggaacaggatatcgaaacggtcaactatttgaatatcccgacagacagaccgatcttgtttaaaatctcatctgccgactctatggcatctctgtggattccgcagcttggcgggcaaaaatacgccatgtccggaatggaaatggagcaatatttacaggcagaccatgagggtacttataaaggccgaaatgcaaacttcacaggcgaaggttttgcagaacaaaagtttaatgtcaatgcggtatctgaaagcaagtttaatgactgggtgaagaaaacgcagaaagaagctcccaagctgacgaaaacccagtacgatgaactgatgcttcctcagcatgcggacgaaatgacgttctcatctacacacctgaagtacgttaatcacggaaatgatgcggaatacgccattaaagcgcgcgaaagactgggctataaaccgttgtctccgcactctaaatcagatccgtttgaaaacgtaaagacaaacaaagatcaaaaacaatctgaagaccaagattctcactaggaaaggaggaagcttgcatgaatttgaaatgggacgaattcataattacaggtgacccattaattcttggagcacagatttccattttgcttacttcaattgcaatcgtatttgtgctgacatacttcaaaaaatggaaatggctttggagagagtggattaccaccgtcgatcataaacgtttaggaatcatgtacatcattgccgcagtcattatgttcttccgcggcggtgtcgacgggttaatgatgcgtgcccagctcacgcttcctaataacggctttttagattccaaccactataatgaagtatttacgactcacggtacgatcatgatcatcttcatggcgatgccgtttcttattgggttaatgaacgtggtcgtaccgcttcaaatcggtgcgcgggacgttgcttatccttacttgaacaacttgagcttctggaccttcatggtcggagcgatgctgtttaacatttcattcgtcatcggcggatcgccgaatgcaggatggacggcttacatgccgcttgcaggcaatgagctgagtcctggacctggacagaactattacttgctcggacttcagatcgcgggtatcggtacgcttctcaccgggatcaactttatggttaccatcctgaaaatgcgtacaaaaggcatgactctatggcggatgccgatgttcacttggacaacgctgatcacttgtgtgattatcattttcgccttccctgtcttgacagtggctttggcgctgatgacatttgaccgcttgttcggaacagcctttttcactttggcaaacggcggtatgccgatgctatgggcgaacctgttctggatttggggacatcctgaggtttacatcgttattttgcctgctttcggtattttttcagaaatcattgcaacatttgcgagaaagcagctgttcggctataaagcgatggtttattccattgtggcgatttcggttctcagctttatcgtttggctgcaccactttttcacaatgggcaacagcgcggcggtcaactcgttcttctcgattacgacaatggcgatatcggtgccgaccggggttaaaatctttaactggctgttgacgctgcatcgaggcagaattaaaatcacaacgccgatgctgtggtcgcttgcatttattccgaacttcgtcatcggcggtgttacgggcgttatgcttgcgatggcagctgcggattatcaatatcacaacacatacttcctcgtatcgcacttccactacgtgctgatcgcgggtactgtgtttgcatgtttcgccggattgatcttctggtatccgaaaatgttcggtcacaaactgaacgaacgcatcggaaaatggttcttctggctgttcatgacgggctttaacatctgtttcttcccgatgtatttccttggattgcagggaatgcctcgccgtatttacacatacggagcagaagacggctggactgcattgaacatgattgcgacattcggcgcattgctgatggccgcaggattcatcgttctctgctataacattttctacagcttccgtcattcaaaacgcgaggaatcaggagatgcttggggaatgggtcgcacgcttgaatgggctacatcttctgcgatcccgccgcactataactttgcggttctgcctgaggtcacttcacctgacgcatttgcgcaaatgaaggaagacaatgtcgagattcatcctgaaagcaagtttaaaaagattcatatgccgagcaattcaggccgtccgtttatcatgtcattatgcttcggatttgctggattcgggcttgtctttgaatggttctggatgggaatcgtcggtctgatcggtgtattcctctgtatgattcttcgttcatttgaatatgacgacggctactatgtaagtgttgaggaaataaaagagactgaacgaaagaatgccaagtaaaggaggcgggattgatggaacatgcagaacacagcaattctaacgctcctatggaataccgttctgaaatcggaaggttgaatatccttggcttttggatttttcttggagcggagattgctttattctctacgttatttgcgacctatgctgttcttcataacagaacagcgggaggcgtactgccggcagaactgttcgacgcgaagctcgttttaatcatgacgttcctgctgttaacgagcagtttcacatgcggcattgcagtgcatgaaatgcgccgcggcagtttgaaaggcgtgatgatctggatgatcattaccctgttgctcggtgctggctttgtcagctatgagctttatgagttcaatcattatgtacacgaaggtgccactttatcgacaagtgcttactggtcagcattctttgttctattgggaacccacggactgcacgtatcgattggtatcttctggattatcggcatattgcttcagacgaaaaagcgcggcctcaccccgcaaacgtctgctaagctgtttatctcaagtttgtattggcacttcttagacgtggtatggatcttcatctttaccggtgtctatttgatagggttggtgaatgtataatggcagcaaaacaatcggctgaacacagccactttccttggaagcatattgtcgggttcgtgttgtccattgtgctgaccttattggccttgtgggtgatctatacggatttaagcatggctgcaaagctgtggattattttcggttttgcgatcattcaagctggacttcagctcttaatgtttatgcatatgactgagagtgacagcggcaaaatccaagtcgggaatacgctgtttgccgcgtttattgcggttgcgattattgccggttccgtctggatcttcgctgctcacaactatcacggagacaaccctgagggcggttctccaggtgcaaaacattctgagcacagcggacattaattgattggcaaaagagtgcggatttcaactatccgcactctttttcatacactcttaaccgcgttttacgccgcggccgaatttgccgtcgcccggcttgctctttttagaaagagtaacagtcaggaatgaaccatagcttttaacttgagcactttccaatttgcgcatctgtgtcacctccttattacttccagttgattacataatcatgctatcatagaatatagtggtaaaaaccacaaaaaggcactaaaacccgacatcatccttcaattctattcatggggtttttattgcggtatttgttcggaggaaactgatttaaggagagtgttactgatgatacgcgtgttgttagtagacgactacagggttctgacatccggaatgaaggaaatattaaaaaaatataatatggatgtcatcgtttgccacgaaggaaatgaagctctcgacctcttaaaaaaccaagaggtacatatagacgtttttctttatgatttaaaaatgccggggatgaacgggttggaactgtctcttaaaacgctggaaatcgaacctcaatccaaaattatcattatgttttcgggagatgaaattcactcatattttaataagttgatcgaggccggagttaaagggtttatagataaatcgtatacagacagcatgatagcttcgagtattttattgtgtttaaaaggggctgtgttatttcccgacggcttgctgcaaaaactgaggctcgactccgatctctcggtggacgagcatttaacagacacagaactggatattttgcagaaggtggccagcggtaaaacaaataaagagatcgcagcagacctgcaaatgtcgacgcggaacgtagagtatcacttgagcaaaatctataaaaagctcaaagtaacgtcgcggtactgcgcagtaaaaaaagggacgatgcttaatttgatcaagcagaaagtatagacaaagtatatattcgtttttccctgcaaaagagagtcgataggctctctttttctttttcctccgaataaatcccgtaataatggcccattgatgccattggctaatcatgtcggttttcggtagttttttgcggtttttttaatattgtcctgtgataatctgattcatgtgatcagttggtaaattcaggggcatcgtcgcattgcaggctctttttaaaacgctccagcgctgaaatgataacgagggcgtggaaagaacatcatgcataaagtgctgaaagagagcttgccggctctcttctcctttatttttctgaaatcatgcataccggggaggtctaatctttgaaaattattcgaaatcaagagacagcgacaaccgtgttggaaaatgaatgcatcgtcctaaacctggacaatgggcagtatttcggattggaaggggctttaaaagagctgtggatcgaaattgaaaatgagcgaaaggataaaaaagatattctgatcaagtggcaatcggcgttcgatcagacggaagaagaactatcagcgatattaaatgaggcgatacaggaactgacacatcataagctcattaaaatagaggataaaagctgatgaaaaaaagagcgcttgtcaaaaaccacgaatattttacaaccgttcatgcttttgtacgtatgatgctgttaaattatgactttgaagaagcttatgaaaaaattgcgatccacctgtttccgctgtatgcgagcgcaaagcaaagaggtgcagggcttcttgatatagacgaactgcaccggaacggcgaatatttgtattcccttgatgaagacgaccatttggtcacttcatgcgtttctattgcattaacgattcaatctatattattcagcaatgggtctgatgctgatctcatgatcggggtcaagaaaattgatgacaagctgttttctcacgcgtgggttcaaatggaaaacggcaaatcgatcgatccgaatcataaaaataagaatttaaaagttttacagacatataagatgagcgcttacgctgaaaggtgggtgttatctctagtatgaaaatatggtttggaatgcagggaaacaacaccgctttatggcaagagtgggtttccgccgtcaagaaatggggacgggcggaacggattcacagctacagctgcgggatcgcaaacatggctgaagcgcatatccgatacgatgaagcttttagaccttcaactcaaataaatcttttgcaccccgtcatcttagacggctggatcagcggcggtcttaacgcaaaatcggatggcacccgaaagatcgagcaatatgacaagctgtacgcatcattgaagcaggacaaagctgccatgctgtctcactcgcatggcgaatatacgatggtctggtgggatgacagtctgcatagccttgttttggcgactgatacatacgcaacccgtccggtttactactgggtcagtccgaaaggagaatggtatgcagcgaatgacatgcgcatccttttgcttgttcatgacattccttttgcgatcgatcaagatgtgtgcagaatgtttcctacttcgggctttgctgtaggagaaaacggctttgaagatcggacgttttttaaaggaatacgcaaagtgcctgcggcgtcctacgcttttctcggccgggatcaagcggttcacgtgcacagctattgggggcttccgcagctattaaacgagaaagattttgctggagacgctgttccgaggttccgggagctttttcaggaagtgacagcagatcgtttaaaggatgaaaggcatattgtcgaattaagcggcggactggattcagctgccgtaaccgccgccgcagttgcaggcggacgcaaggaacagctgctggccgtcaatatatcatttgccgaacccgacatgatattaagccacgacagggaccttgtaaagaatatgatgcgagatatggatatccccggcctgatcattcttggagacgctacagccaaaattccaaacgcggaaattgggcgtgatccgctttggtttgtagacggtcctgatccgagagccaattcactggttaatgagacttttacagtgatcgctgaggagtatggtgcctcgtctgtccttacaggtgagggcggggatttcatttttagcggagaagtgtcagtgatcgattccttgcttcggcagagacggttttctgaaatctacaaattgcttcgcgaatggtcaggcggcagcatgaaagagatgctgaagctcggatttcaatacggaatcgcccctttcatgccttatattggagaaaagctctattacgacctgctgtggtcagatacggaatatgagctgcctgaatatttcactgaagaacaccgaaagagagaatgggagatcaataaagaggatcatctacgctatcgaaaaagccgggagctctcagtgtggggcaagaggtttcactatgactttttgtggccgagagcgaggtacatggatgctgttggtgtgacattgcctacgtaccatccatttttggaccggcggctgatcgagttctcattttcagtaccgcctgaacagcattttgatgttttaaaagggcttgaagaacattatgcaggctctaaaatgcttcttcgcaaatctttcaccgatatcctgcctgcctatgtttataacagatcaacgaaaacaacatatgcccatatggccaggaaaagctttatgaatgaccgcagacacgttcttcagttatttgagccgggagagcgcgtcttcgttgaagaactcggcatcattaagcgcgatatatggtggaaacacttgctggctatggctatccgctctgaagatccaaataatgatctgggcatgggctatcagtacatgagatctgttattgacttggaaatatggctaagagaagcatccaaggggaaggagcaccttctcgaccggagccgtccggtaaagccaagggtcatggctgatatcgaaaccgtcaatacgccggagaaagccaaaatatactcgtatcaatgaccacaataggtatagaaaatgaaggtgaagcatgtgtggaagatgaagcatattcaagagccgctgcaaacggcgggcctgcttgggaaaatggtctggaaatccggtccgcggctgatgatttgcatggttatcttcatgctgatcgaagccggagcacctttaatccaattgtacgcttcaaagcaaatgatcgacggcattgtcgatcaggaagccgtcatctatgcagaaatatgggctgtcatttatgcgggaagcctggtcatggtcagtgtcgttaaatcattggaaaaatgggtgaaggcaatgctttctgagaggtcgatgatcacagtcaacagtttgttgatcgacgcttttgaccgcattccggggatgcgtttttttgaggatccaaagtacagggaccggctggaaacactgcgggatcgttcgacatggcttccttcccaattcattaatatcagttcgaacttggtgaccgccgttatgtctttggcgggcgtcgttttgatcatcgcctatctgtcgcccgtccttgctttcatccttattttgtcgaccgctccatttgcttttgtccataatcattacaatgaaatggagtgggaatatcacaaggattatgcccctgtaagaaggagggccgcatatgcgcgccacattctgctcgggagacgatcggccaaagaagtacgcctttttggcctggggtctttctttcttgatttatatcaatctgcttttaaaggcctatattctgtgctgcggaatattcaggtcagaagcgcgcgctggtcggttttaacgggtttcttatcgggggcgggaacgggtttggggtacttttggattctgtcccaatcccattcaagcagtttttctgtgggggatatatcgctgtacttgggggccgtgttccaattatcaacggcactccgggatatcgccaaagaaggtgcagatacgttggatatatggagaatgggaagagacttttttctttttatgaacgccgaaaaggatatcaggcttccttccaatggcgaatctctcgagggcgaaggaccgctggcagtcgaattcaaaaatgtcaccttccgctatcctttcagagaagcggctgccggctcccgggtaaatgaagctgatgtggatgaggaagacttggatatgctcgatgagcttgaagatgaagagatgcggggacaagacgaacagcctgaatcgtatgacatgcacacaggcgatgttctgaatcgaatcagcttttcagtatcaccgggagaaagaattgccattgtaggggcgaatggatctgggaaaacaacgctcatcaaactgctctgccgtttttatgagtatgatgagggtgagattaaagtgaacggcaaagacatccgcaaggtcgatcttcaacagctgagaaacaaaatggcggtcgtgtttcaggagtttggcagatacgaattgtcactccggcacaatatcgcgataggccgaacggaagctttaggcgatgaagaaaaacttcgcgccgccgctcgggccgccaagctggaaccgattgtcgaagagttgcctgaagggctggaaacaatgatcggccctgaatggggcggcaccgatttttctggaggccaatggcagcggatcgctttagccagatcgtttatgaaagatgccggacttgtcatattggacgagccggccgcatctttggatattcgggctgaatatgatattttccggcagtttcaaagcttcacagagggaaaaacggtgatcatgatttcccatcggttcagtacggtaaagatggctgaccgcatactggttttgaaaaacggaagaatcgcagaagagggaagccatcaggaacttatggacaagaacggggaatacagcagaatgttccgcatgcaggccaaatcgtttcaggggaaggatgaggtatattgctgaaattttattcgtttttcaaaaagctgcctcaaaccgcttccatcatattttacggtttaacgttgttttggcgctgcgatccttttaagtcggcggttctgtttttaattacactgctgaatgcaatgctcggacctctcctagtctggctgagtgcagaggtgatcgatgagattgcacgggcgccgtttgagctgtcttcttggaatgcactggtttgggcggcctttgcatacattgcttttacgctgatcgtagatgcccttcagcctgtagctgaaatgcagaaaaggctccttaccgccaagctcgaagcttatcttgatgaaatgctcatgaaaaaggcaatttccattcctgatatcgcggcttttgaagacgcatcttttcataccaatacacaaatcatccgctataatgaatattttgtcacgatgtgggtttccatcgtgtctcaaaccttcggcggaatggtgatgattgcagccagcagtttattgattggcatggctgcaccgtgggtgccgctgctgtttctcatattggccgttcccaaactgtactgggaggcgaagttaaacaacgcgacctttgaaggacggaaagaggttcaggaactgaggcggcgcgcggaatattatgcaggtgtccctcttatgtctgaaacagccggagaggtcaagatatacaatcttgttcctttttttaaatccttttataaaaacacctcaatggagctcctccatacgctgtccaacgatcaaaaaaaactggcgctgtatcagctgttctggtcggtattacaatctttggccgcaggtgccgtcctgatttacatcgttcaccaggcttttcatgggggattatccatcggggatgtgatgctgtttatcggagccgcggttcagttcaatgaaggaatcaatgaaatgttcgctgcttttgcgatcggagcaagagaaacgaggcacctcggaaatgtgcattcttttttaaacagcaaaaattccatggaaaatggggaaaccgctccagctgttcaaaagcaaaaaggatttacatgtgatcaagtggaattttcttatgatggaaccaaaacggtacttgatattcaacagcttgatattccattgaataagacgaccgttctcgtgggagaaaacggatcaggcaaaagcacactcgttaaattgcttctgcgttattttgatcccaatcaaggcacgatctcgtataatggtttaccgctttataagtatgatatagagcattaccggtcaaatgccgcggccgtgtttcaggattttttgcggtacgaaatgacattgaaatacaatatcggtctgggcgacatttcttcatgcaccgacttggccaaaataaaaagtgcttcggctttcggcggagtggatcagtttttgcataagcttgaagacggctatgaaacagagcttggcagattgttcggcggcaggaatttgtcggggggagaatggcagcggatcgccatatcccgcgcatttatgcgtgatgagtctgccgacattttaatatttgatgaaccctcttctgcgctggatgtatttattgaggaagagatatttgataagctgcaaaagctgacgcagggcaaaacagtcattattgtctcgcaccggttaagcacggcccgttttgccgaccacatcatctttttagaaaaaggaagggtggcggaggccggaacccatcaagaattgatgaaaaatcaggcacagtacgcagagctttatcgcctgcaagctgaaaaatacgcgcaataaaggagaaagcaatgagcaatatagaagaacttcgtctttttcgaaaagaagatattgaatggctgcagacctggtttgaggatgcagaggtgaaaaggcggctggaagggatgctccctcttgacgaatggttcaattttgcaggcggtaatgaaaactaccgggtatgggcggctttagaggacggcaagcctgtcggcgttgtcatggttgaagttgaggaggacttgaccgggaacattgcccttttagtcgatccgtttttgcgcggagggggatatggaaaagcgctcatcaaaaggacgatggcattgccggaaatgagccggatcaacaaatggttcgccggaattgaagaggataacaagaggtgcttagcgtgcttccgatccgtcgggtattcattggaacacgaacagccggacgaagactgctactactctcttatttatttcccggaatcttaaataaggagcataagaagatgaacttgatcaaatggattttgttttccgttatttcattcgccttttttcagccggcaccagccgctctattaaaagaaaaggacgactatactattcttgtttatatgattggttctgacatggaaagcgattttcatatggcaagcgatgacattcaggaaatgatggatgcgggttcatcttcaaacgtcaatgtcgttcttcagacaggaggagcaaaaaaatgggcgaacccgtcgatcagtcacaaggtgaatcagaggtggaaagttgaacatcagaagctggtgcccctcgaaaatgtcgggaagaaaaatatggacagtcccggctccgtcacagattttatcacatggggagtcaaaacatatccggctaaaaaatatgtattgatcttttgggggcatgggcttggctcagttgacggctacgggggagacgaaaacttcggcaataagaaaatgaaaataagcgagctgcagtcgggaatcaaaacggcctatgaacatacgaagcaaaagtttgatttaatcggttttgacaactgcaaaatggccgggattgaaacggcatatgccttgagggattatggtaagtacatgctggcttcagtcgactatacgaatcaaaacggctgggattataaaagggcgctgcagtctgtacaagacgacccttcaatcgatccgaaagagcttggcagggaaatcgctgcaggctacgtacagcagtcaaaagaaaacggtgaaacagaagacctgcagcagtctttaattcaattgaaccgtgtcaaagacgctgtcgatgccctcgacagattgagcgtaaacatgaacctggcattgaaagagcctgacggaaagcgcctgctccactacgcgcgtctcgctgctgaagattatgcagatgaatcggatatggttgatttggcggatttgtcaagcttgatcggtcagcagatcggagccgagaaagaagcaaaagaggtcgtaaaatccgtcaagaaggctgtcatcatgaacatcaaatctccggagcatccaagaggaagcggcatgtccgtttattatccggccagagacaaccataagcggtttgcggaaaaatcgaaaatataccgcctgcttgacttcagcagccggtatcaaacattcatcaaagattactcgcattcaacatttaactttgatctatagttgcgtttaacagcaaaaaagcgccggcggaaaaaccggcactttttttatcggctcatgtgcttccggatcaatggaagtccgtagatgatgaaagcggcgacatgggcgatgacaacgttgagaataaagagtgcgatcatgagagagtgtcctgtaggagaaaggctgctggtcatatagaaaaagaagaatacccacattaaaatgatgggcggaatagaagaaattgcgacctttttgttgtccagccataaaaataaaggagtggcgcttgcaatcagcaagtaagcgaaaaacatatccatgcgttttcagcccctttcgataatgatagcgctgtcaaaaaaagcggaatgaaacatcaattgtgtctaattggagaatattttgtgaacattctgttacatttattataccacgttcttcgaaaaatgatacatactggaaagcattttccgctccaactatcggctcaattttcacggtgattcagttaggacataaagggtgaaggggagaagaagtgaatagcgaaaatgcgtggaggagattgatcatgcgaaagttagccaagaaccgcgcgtttcctatacgaggccggcaggcttacgggaagcgaagaagcggacaggcggatcgtacgataaggccgcagaccccttggatcaacgatttttttctaaacaaaaaaggccctcggcatttggcgccgggagccttttatttgtctaaaaaataaagttggcacacagtacaatgacaggcagcgtaataagcgtccgaacgagaaaaatcaagacgaggtcaaggaacgtcaccgggattttggaacctagcaaaaggccgccgacttcggacatgtagattaattgtgtaaccgatacacaggcgatgatgaacctggtcatttcactttcaatgccgcttccgagcacggacggcaggaacatgtcggcaaacccgacgacaagcgtttgtgaggcctcagcggcttcaggaacctgcagcagctcgagaagaggaatgaacggcagtccaagccatttgaaaaccggcgtatattcagcgacaatcagcgcggctgtgccgagcgccatgacgacgggagcgacgcccatccacatatcgagtacgtttttagccccgtcctgcaagaaatctttgacgcttgtattttgttttgcttttgcgacagcctggctgagcccccattggaacggagtgtatccttcgggaatcttctcttgatcctgatccgcttgatctgtaatataagtatcagcctttcttgataaaggcggaatccgcgggctgatcaccgcagctgcggcacccgccagcaatatcgtcaaataaaacggaacgaacatatgaggaaggccaacctgtgaaataatcacaaggcaaaacgtgatggagacgactgagaaagtcgtgccgatgacggcggcctcacgcttcgtgtagaatccttcttcatactgtttgctcgtcaggagcacgccgatcgtgccgtcgccgagccatgaagccatacaatcgatcgatgaccgccccggcagcttaaagacaggcctcatcaggtttttcatcaaagcgccgcacagttcgagcaagccgaaattcaacagaaacggcagaaaaaggcctgcaaatagaaagacggagaagagaacgggaagcaggctgaataataatgttccgccggtactcttggcatacaccgcttcaggtccgatcttaaagtacgccatcacggcgaaaatcatgccgactaggcggacgatataccaaaataaagatacattcagcaggttatagaaaaactcgctttttttgatgaaagccggatgaaaggttttggtgataaaggttaagataaatgttgcggttacgatgaccgtcatgatcagcggcaattgctgctgaagcagctcctgcaatgcatttgaaaaaacagcaattggaatcgttaaatttccttcaattttaacgggaatcataaacagaataattccgataagcgaagggaccaaaaattttatgatatcaagccgtttacgcttttgaagtgctttatccaaatgaaaaactccttatgaattggtgattctgtaccacttctgccggaggcaaaagtttaattttatgcaacattactcattttaatacatttcaagcaaaaatcaatgaatttatcacattcgacaatagttggaaaaatcctttaaaatagaataggaatttgttcgcaataaaatcgaaacattttgttcttttgtacgtcatatcatttgtgaggaagcggatgccgtcttcctgcattaattcattgtgtcatattataagggcgggatttcgaatgagtcagaaaaagaatattacaaatcccttttaccagggggatttgatttttgtctatattgtcttttttatcataagcgttgtggctgtgtacgctgctcagcagtttaatcaatataatgaaccctttgcgatgaaacagtccctttactatttactgggggccttcatcatcatcgtgtttctttattttgatttggagcagcttgaaaagctcagcttttatttctatctgctcggcattttgatgctgatcgtgttaaagttcagtccggcatatatcggatcatacaggtttgcgccggtcatcaacggtgccaaaagctggtttatgcttcccgggtttacgctgcagccgtcggaatttatgaaaatcgggctgatcatgtacttggcttccttcatgtctaaaaacggccctgtcggcaagcgtacgttgaaagaagactggatttttctgctgaaaatcgccggtatcatcattgttccgttcggcttgattttagagcaggatacgggtacagccgggatcgtcgcgtttgtgatccttgtgatggtattcctgtcgggcgtgaactggaaattgatctctcttatcttcggaacgggtcttgcagccgttgctttgattttatatgtcatcatcaaatttcccgatgttgcgggagcgctcggggttgaacaataccaaatcaaccgcgttatgacctgggtcaatccgagcgaacagaatgccgacgataaaatgcaggtcgaaagggcgcaaatggcgatcggttcaggaaaagtattcggaaatggtgtaagcgatcttcaagtctatgtacctgaggcgcaaacagactttatttttgccgtcatcggcgagagcttcgggtttgtcggatgcacttttgttgtcattatgtttttcttcttaatttaccggcttgtcgtgctcatcgaccgaatacatccgttcagcaggtttgcctcatttttctgtgcgggctttaccgctttaattgtcattcacacctttcaaaatatcggaatgaatatcggcattatgcccgtgaccggcgtcccactgcttttggtcagctatgggggcagctcagtcgtagcaaccttgctcggcttcgcggttgtctacaattcaagctgccagttaacaaagtatcaaagctatatgttcaaataacagcctgatgtatgcgggctgttattttattcaccctttttcgcaatgtgaacggttgttcatgctataatgaaagttagtgcttttgatgaagaaataaggcggggtataatgggccagaagaaaaatacgacaagtccctattatcagggcgatttgatttttatattagccatgttctttttaatcagtgtgatcgctgtttacgctgcggagccgtctttttcaccgaagggttatccggcaaagcaattgttcttttatctgctcggcatttcggtgatcgtcggctttctctattttgatctggagcagcttgaaaagttaagcatttacatatatttattcggcatcttgtcgttgctcgtgttaaaagttagtccggagtcgatcgctccgattaaaaacggcgcaaaaagctggtttcaatttggtacgatcacgctgcagccgtcggaatttatgaaaatcggcctgattatgatgctggcttcggtgatttccaaagcaagtccgaaaggctcgcgctcgatgcaggaggatgttcgcctgttgctgaaaatcgcgggagtgtcggcggttccggtcggattgattttaatgcaggacgccggtacggccggtatctgcatgttctttgtcgccgttatggtgtttttatcaggcgtgaactggaagctgattttcatagtcgcgggatcgggcatcacgctcgtactgctcgttctgtttttggtgatcaattttccggagttttcaaaggatacattgcatatccagcaatatcagatcaaccgggtgatgacatgggtcgattcgagccagcaggacgcgaatgatacgtatcagaccgaaaaagccgttacggcgatcggctcaggagaaatcttcggaacgggcattaacaatttgaaagtatacgttcctgaaggccaaaccgatttcatctatgccgtcatcggcgaaagtttcggctttatcggctgtacatttgtcgtcatcatgtttttccttctcatttaccggcttgtcgtgctgattgataagatacacccgtacaacaagtttgcatcgtttttctgtgttgggtatacggcgctgattgtcatccacacattccaaaatatcggaatgaacgtcgggctgatgccggttacgggcgttccccttctgttcatcagctacggagggagctctgtattgtccgcgctgatcggctatgcgatcgtttataacgccagctgccagctgacgaaatataaaggctatatgtttaaataaaaaagacagccgaatcaggctgtctttttagtcttggtttaaaaatgctagagccgccgacacaagaattttcgccgcgttcagcatgcctttttcatcgatgtcaaacatcgggtgatggtgcgggtaaacggctccagtctgcggattgcccgcgccggtaaaaaagaatgatccagggacatgttcaagataataagagaaatcttcgccgatcatattcggttcgagttcgatgacggcttcagggccgacgacatgtttggcgcattgacggacgatgtccgtttcattttcatggttgacgacaggcgggtagcctttttcataatcgagtgaaaacgaggccccgttgctgtcgcagacgcctttaattacgcgttcgatctcggcgatgatcgtttcctggacatgctttgaaaaggtgcggaccgttccttcaatgaccgcttcttcggcaatgacgttaaatgcctggcctgaatgaaatgttccgatcgacaagacggctgcttctgtcggatcgattctgcggctgacgatttgctggagatggttgacgaccgaggctcccgtgattaaagcgtctgtcgttaggtgaggcgcgcctccgtgtccgccccgcccggatatcgtgactttaaatttatcagcggctgccatcatcgggcctgatttgacaccgacttgaccgacgggcatcggagcccagatgtgggtgccgaaaatggcatccacgccttcgagacagccggcttcaatcatcggcttggcgccgcctggtgtaacctcttcaccgaattgatggatcagcacgacatttcccttcaagtcttttcgatgctttgccagggcttttgcggctgtgaggagagcagacgtgtgggcatcgtgcccgcaggcatgcatgacgccggggacagtcgaccggtacggaacatttttttgatcctgtaaaggcagagcgtcgaaatcggctctcaaggcgaccgtcttgccggggcggccgcctttaatgtgaccgacgaccccttggccgccgacattcgttctcacgccaatcccgaggctttccaagtaatttgcaatggtgagcggtgtattgacctcgcgatgggaaagctccggatattggtgaaaatgtctccttagttcgatcatttccggaaataatgcatctaattcttcaattacggatttcaccgtcatctccctttccgattcgaaaatagtaagacaattctatcattttaccatatgaaattgaatccatctgcagtccgccaaaccgttttgctttagagaaaagcagatattggatatgataaaggttgaggaggtaagaggatgaataaaacgattgaaactattttaaatcaccgttcgatcaggtcttttacagatcggctcctgaccgaagaagaggttcgcctgcttgtggagagcgctcaaagcgcatcgacgtcaagctatattcaagcatattcaatcatcggtgtcaccgatccggacaagaagcgcaagcttgcggaattggccgggaaccagccatatgttgaaaaaaacggccatctgtttgtattttgcgcagatctttacaggcatgacaaaatcgctcggaaaaagggtgtagatattacagcttctcttgaagggacggaaacctttatggtcagcgtcatcgatgcagcgcttgccgctcaaaatatgtcaatagcggccgaatcaatgggcctcggcatctgctatatcggtgggattcgcaacaatttgaacgaagtctccgagcttcttgaaacacctgaatacgttcttccgctgttcgggcttgtcgtcggccagccggccaacccttcggccaaaaaaccgcgtctgccgcttgatcacatttatcatgaaaatgtctatcaagcggatgatgccgagtttgaaaagcatttgtccgcatatgacgaaacgatttcaaactattatcaaaagcggacggacggcaaacggtctgacaaatggacagaccagatcaccggcagcctcaaaaagccgccgcgtgcgtatatgaatgaattcgttaaaggaaaaggtttgaacaaaaggtaaggaacctcccctccgactcggaggggacttatcttatcagcatgtattgaaggaaaagataaaacatcagccaaaagggcagactgaaaaggattccgaataaacagccttttgcaaagcgttcttctacggctggcgggtgcgttttttgcttcgtctcattcatcagtactgggagctcctttagtttatccatgatactattatttctttttgcgcagaaaaagtaaacgaagatttggggtgaaaaagatgttgtcattaagcatactggatcagactcctgtttctgaaggaagcaaacctgaactggctttgcagcatacggtggagcttgcgcaagcggcggagcggctcggatacaagaggttttgggtttctgagcaccatttttccaggaacttggcagggtcaagtccggaggttctgatcggttatcttgcggctaaaacagagaagatccgtataggatccggcggcgtcatgcttccgcattacagcgcctacaaggtggcggaaaacttccgcgtcttggaaggacttgcgcccggcaggattgatctaggtgtcggacgtgctccgggagggatgccgatcgcttcaatggcccttcaaaatggaggaagacggatggctgaccaatatccagaacaaattcaggacctcgtcacatatttatacgatcaagccgatgaacatcaccgctttcccaacttgaccgcaacgccgaacatcgccacagcgcccgctgtttggctgctcggctcctcaggggaaagcgcaaggcttgccgcccaaacaggggcatcatatacatttgctcaatttattaacggtgaaggcggagaagaggcggccagactgtacaaagagaggttcgaaccttctgtattaggggaacagccaaatgtgatcgttgccgtatttgtgatttgcgctgagacagaagagaaagcggagaaccttgccaaaagcttggatttttctttattggccaatgaacaggggatggtgaccgaaggctttccatcattggaaacggccctgtcctatcaatattctccttatgaaagaaagagagtggaagacaatcgaaaacggatggtcatcggaacgccgcagcaggtaaaggaacagctgcttgaactggccggcgcttacggaacggacgaaatcatggcggtgacgatcacccacgattttcaagacagattggattcataccggctgctggccgaagcgtttcatcagtcaatttagcgtttttgctgaaaaaaatcgagaaaatggcggattgggaaaagaataaacagaatgcatatgtataaagcggtaaacagccagctgagcggaatgaggatgatggtatcgacggtttgctccgcagctttttgaaaaggcttgggctcgcgcttctgcaggttgacggcgaagtacaaaatcgtgaaaaatataaagcagacaataatgaaggataagccgaataatacgataaaagaaagcatatacacgatgtcctccgattgcttttttcacgttttgaagagaagggggagcttctcctgaacgcattatccgtattttaacataaaaaagccttgttgagtggttctcaacaaggcttgtcattattcgacgataaaagggtcttccgtcaatacgtagcttgatttccctttggcggatgcataggcaagcatatagtattttccggacttaagggatgcggcgtcattgattttgccgttccattgataagattgatagcctttgccctggtttttgtaaacgccggcctggccgagaaggttcaggttttcatcatagacgagaaatgcgagctcttcagccccgcccggcaggtaggcttcgatcgtgtaagcgccctgctttgctcccggttcaactgttacggatgtgacgcgcgggtagtctggctctttgacgatcaataggagcgggatttcggcgacttttcttccgtcttcacggatgtaaaccgtgccttcatatgtgcctgctttcgttttcgcggaattgacggttacttttgccgctgctttacctgtttgattggccggtaccacgactcgttccgttcctgataccgtgatgcccgttcctttaaaggagtattcgagctgataggcttttctgtgtgaagaaaggttttcaatcgtgaacgcttgttttttcgtctgtttccctttgtctttcaggaatgttccgtatgaatggctgcccggcgttacaatggatgaagctttaagggcctccatgatgcggatgctgcccgctccttgcgtattgtgagggagaggctttccattttcatccgtcagtttttccgccgtattcatcagtacgcctttgatttgctcaggcgtccaatccggtttggcctgctttaatatggctgccgttcccgcgacatgcggggaagccatgcttgttccctgttttgaaccgtaaccgtacgggtttttcggatcgtgggtcggaatggtgctgacgatgttgacgcctggcgctgaaacgtcaggtttaatcatccatgtatccatgacaggcccgcgggacgagaatgaggcaattgtttcccccagctttttgtccaatttgaaagaaaagacaacggagtgtttcccttctttgatctgttgaacaagcttttcgccctcttcttttgacaatttgacggtcggtacggccatccccatgacgttggcctcgatttcccctgttgcattattgtaaatcacggctccgatagcgccggcgtttttggcattttcagccttatcaacaaatggtatgacgcctctctggataaccgcaacttttcctttcacatctttgcctgagaaatcgtcagcttgtccgaggccggcttcaacgagttccacctcttgaccgttcaatgcttcaagatccttttcctcttggtatcccatcacctttgctgatgaatacgaaggaagcgtcaccgaatactcattatacggaagctgtgatgcgccgacggaaatcgcaacccttgatgttcccggcgagccgaccgtccagttttccggtccgctgttaccgtttgacgtaacggcgacaaccccttcagccatcgcccagtccagtgcgatgcttgttgcataatcagggctgttcagcgaatttcccaatgagaggttcatcacttttgctccgtctgcaacggctttttcaatgcccgcaatcacattctcggttgtgcctgagccgccggggccgagcacgcggtaagcaagaagcgttgcttcaggcgccacgcctttaatctgtccgttcgcggcgattgttcctgcaacatgagtgccgtgatcagtcgctccgccgcgcgggtcgcctgtcggtgtttcctgtggatcataatcattatccacaaagtcatagcccttatatgggccgaaattattctttaagtcgggatgggtgtaatccacgcccgtatcaataacggctaccttaatgcctttaccggtatagcccgatttccatgcctgatccgctccgatgaacggggcacttttatccatctgtggataaatggcgtctgctgcaagtgtcacgtcttttccttttacgctgtcaggtttgtaagttgcgtttggataaaccgctttaacttccttgacggcgagcagctttggaatttcactggccggcagtttcatagaaaagcccgaaaatacacggtcgtattcgcggtttactttcgcttttttaagtgttttcagcgctttgcttttcgctttgcttcgagctgtttttagagaagccttcgtttgtttttctccgtccgcttttgcttcggcaagcgacttttctttcagttccacgataaccgtcgtctgtttatcagacgtcacatcaatatcaccgtagatttcagctttctcaagctcaggcgactttttatcgggaacggaagttgcctgcactccggtgaggaatgtggataacgcaaataatagaataaaagccataacaaaatagcgcacgatactttttctcaatctgttttcccccttctggataaatgtttctttgtaattattagagtttcgaacttttaaaatattctctcagtttcaaaaaaatccttctatatatagaaataattttcaaagattcaatgtattggagtgaatttctctagatttatgcacaatttactgtgtataagtgaataaacttgtgtatagatattgtagggaatatacgttcttatactaaatattgaataagtatgtggatatgtggatatatcctgtgggtaatatgtgtttatccttaggataagctgtgagtaagttacattcatggtttgtatccgctgaatcatgcgattccttcagttttcaacaaaacttctaaaaactagaatcattttgcacacacattgtgacaaacattttcattttgctgggataagatagagcaagaaagtttaatagagttgctagttttatcaaaacgaaactggagggatcggtatgaaaggtttgatatcatttttaaaattatggacagccgtgctgctgaatgcggtgatgcctgtcagagaaaatcagatgaaggtgacggcgttcgccggcggtacatatcaggctgccgatgcttatcaggcaggcggcttttcggaaaaaagagaagagaagacagagcggatgtcgggctgtaagagaatgaagcccggcagttatacgacagaacccagccgggctgtttgcaaaaaagcggtgaaaagggtaagagccggaccaactctttacacgggaacttaaacaaggtaaaatcccactcataatgggaagtgggtgacagctttgaaaatctataaagtattgaacaacaatgcagcaatcataaaggaggatggtcaagaaaaaattgtcatgggacctggtatcgcttttcaaaaaggcaaaaacgataccattccaagaaacaaggtagaaaaaatttttaccattcatgaagaaaatgaaaagtttaaacaaatcctcgaaacacttccggaagaacatattgaagctgccgaagagatcatcagctatgcggaagggcagctgtccgcaccgttgagcgatcatatccacatcgcccttgtggatcatttgtcatttgcgatcgagcgagtccgcaaaggattcgtcattcaaaataaattgttaaatgaaatcaaagcgctttataaaaaagaatatgagatcggactctgggcaatcgatttggtcaaagaaaaactgaaagtcgaattgcctgatgatgaagcgggttatattgcgctgcatattcataccgcaaaaatggatgcggaaaacatgcagaagactctaaaatacacgaacatcatcaaagaattgatagaaaaaatcgaatgctgtttcaatcagaagattgacgaaaacagcatctcatatcagcgtcttgtcacgcatctcaggtatgccatcaaccggctggaatcaaatgaagcgtttcatgtcatggacgatgacatgctttatttcatccggcaaaagtatcctgaaagctaccgatgtgcggcagggctggcggattacgtaaaaactgaatatgatcttcatcttccggaatcagaagtcggatatattacgctgcatgtccagcgtttaaatgattcctataggtaataccgcctgatatcgcgcgatcaggctttttttaggtcgattttcacagagaataaaaaagtagttgacgaaagcgttatcacataataaaatgaaagcgtattaaaaaataaataccggggattgtgactggtaaagcaggcaagacctaaaatttgctagatgaatggggaaaatctatcctccattcgttggtgaattttaggtcttttctgcttttttttaaaaaaaaaggaggagtcatcatgattcataaagaaatcgctgtacgtcttatacagcttcttggcggagaagataatgtcatcagtgcagctcattgtgcgacaaggcttcgtttggtgattaaggacgaagcaaaaatcgaccaggaaaaggtcgaagagctggaaggtgtaaaaggagccttttcaagctctggtcaataccagattattttcggaacagggcttgttaataaagtgtatgaacagtttgccaaagagctgaatcttgaccaaaaggaaacggttcagcacagcgatgccgcaaagggaaaaatgaatcctttagcgcgatttgcgaaaacgctgtcaaatattttcgtgccaatcatcccggccattgttgcaagcggtttattaatggggctgttgggaatgatgaaggcatttcagtgggtcgatcctgatgcggcgctgtataaaatgcttgatatgttctcgagcgcggcatttattatccttccgatcttgatcggtgtcagtgctgcgaaagagtttggcagcaatccttacctgggggctgtacttggaggaattttaattcacccgagcttgttcaatccttggggacttgcaactgcatcaccggatgtgatggacttttacggactcaaaatcgagatgcttggctatcaaggaaccgttgttccaattttgcttgccgtatatgtgatgagtaaaatcgaaaaaggcgtaagaagaatcgttccaaatgcgatcgatctattagtaacaccgtttgtcacgattatttcaacgggattcattgcttttatcgcgatcggtcctttaggaagaatgcttggtacagggatcacgaacattttaacatatgtgtatgacgttgccgggcctgttgccggactgattttcgggggaacatactcgctgatcgttctaactggtgtccaccacagtttccatgcgattgaggccggccttatcgctgatatcggcaggaactacctgctcccgatctggtctatgtccaatgtcgcccaaggcggggccggacttgccgtattctttttggcaaagcgtgcaaaaacaaaagaaattgctttacctgccgctttctcttcttttctcggcattaccgaacctgttattttcggtgtcaacctccgttaccgccggccgtttatcgcggcaatggccgggggagcgctgggagctgcatacgttgtctttatgaatgttgcagcaaacgcatacggtttgacgggaattccgatgattgcgattgtcgccccgcttggaatgggcaacctgatccactatttaatcggaatggcgatttctgtgactgtcgcatttatcacagcctttatcttaggcattaatgaagacgagaaaaagtgacggagggagggaaaacgatgaatcaagatcaggagcttcgtcaaaaggcaatgaaccgggttgaagaataccgggatattgtaaaccttgatccctatcggctgcattatcatatcatgcctcctgtcggactgctgaatgatccgaacgggttcattcagtggaaaggggtgtaccatcttttttatcagtggatgccttttaaaacggggcacggtgcaaagttatggggacactactcctcagcagatctggttaactggcggcatgaagagatcgccctcacgccgagcgactggtttgataaaaacggttgttattcaggaagcgcgatcgctgaaaatgatgtgctgcatctgttttacacggggaatgtcagagacggcgagggaattagggagacctatcaatgtctcgccgtctcaaaagacggcatctcgtttgaaaagcagggggttgttgcaaggcttccgaaagggtatacggctcatttccgcgacccgaaagtatggaaaaagaacggcagctggtacatggtgctcggcgcccagactgaaaatcttgagggaagggcggtgctgtttcaatcggataatctgaaggactggcagttcctcggcgatatcacaggttcaaatacagatcagctcggggaattcggctatatgtgggaatgccctgacatgttcgaactggacggcaaagacgtcttaattgtctgtccgcaaggccttgaagcagaagagatgctctaccaaaacgtctatcagtcaggctattttgtcggtgaattgaacgagctgaaaccctggtttacacacggagatttcgaagagcttgaccgcggctttgacttttatgcgccgcagacgacaaaagacgaatcaggccggaggatattggttgcctggatgggtgttccagaccaagatgaacagagccagccgacgattccgcatcaatgggtgcactgtatgacattgccgagggaattgcatttacaaaacgataaaatcgttcaaaaaccggtcgaggagcttagaacgctccgccaaaacgaaaaaaacgcggcaatatcgcttaatcaaggcaccgaaaaattggacattgttcaaccggacaaagctgagcttttcatcagtccgaaagttattgaagagggttttgagatttccttcaggggtgcagcccgactcatatacaataaagcagaaggcatcataaccttggagagaaacagttatgttgatgaaaaaacggaagccagacagtgccgtttgcaggagcttcgcaatttaaacatctttttagacgcctcttctattgaaatcttcgtcaatgagggagaggaagtctttacggcaagatattttccttacccgggaaataatgatgtttggatcagtgccagaaaagaaatcataatgaatgtgacatcctggacaatggcataaagggagcggctgctgtttgctattttctgtacaatccctttatgatatgctttttttagagagagtgcagtataaaggggttgtttttgtggatcaaaaccagcagaaattgaccgctatgcgtttgaaaaaaatagcggaccatattgaggatacgagagaggaatacaatggtttgctcctccagatgaagaagctgatcggcggtattgaagataaaacaattccaaatgatgaggaagtacaaaagaaacttcaggacacttatgaacaaatgaaagaatatgctctttttgtggaatcgatcgaatctttcttaagatcatctgcaagaacgatcaaacgggaaagctaaatgaaagccccttttacataaaaggggctagcgccgatggtagttgggggcttccccctgtgagagtaggacgccgccaagctgttatatatctttaccctgcatgaattgaagcttttcttattccgcagtagctcagtggtagagctatcggctgttaaccgatcggtcgcaggttcgaatcctgcctgcggagccaatgcttccatagctcagcaggtagagcacttccatggtaaggaagaggtcagcggttcgagcccgcttggaagcttaagtgaatacgttgatatgacaaggtttctcctgttgtggggaaagctttttttgtttttgcgatattttgcttttagacttattgaatgtataaaagcaggctaaatgcctgcttttatttttatccccataaaacgttcagtgtgacttcaaagacaagaagagacaacatataacttgcgtactttaacgtatcaggttcatgctgttttgagtctttaaaagtccatataaataatgcagcaacgcctataatggtcacgattttgctaagcgttaataatgacatgacgaccttcctttatattgaaaattcatttatcatctatcttctacatttataattaaaatcccttttagctgtaaaaactttctctgctgttcaaaatccatttaaaatagagaagatccgattattcacactgccaaaagacttaatgttgttttggatgtttgaaaatagaatgacgtatctgctccctgtcagactgaaactgtttaatatgttgtagccgggcatgacaccgtggcttgaatagcttcctggagacacataaaagcccatgccgtatgttgctttattcggcgtaaacattttcataaaactttcattggaaatgatttttctttcgtaaagtgctttatcaaacaaatacatgtcataagcggtcatataaatatcaccggccccgtaaagctgtgataaatccggcatgtcaggcgtataaagctttttttgcaggtttaatttatatcctgtcgatggatttgactctttagcaaatgttttataaaagcctgcatgtttcataccggcaggtttaaaaatatgctttttgatgtattggtcgactggttcaccgcttaccatggaaacaatgtatgccagaaccgagtaattggagtctctataatcccatttcccagttgggtattttacaccccgtttttcgatatctttaattaaatcttccggcgaaatatatccgcggccttctttgtgacccctaattccggatgtgtgcgtcaagaaatgataaagggtgatctttgagccgtttggaaaattgggaagatacttagaaacagggtcatttacagatagcaatcctttttcctccagctgtaaaattgccgttgcaataatcgctttttgtgatgaccccacataaaagacggtatctggtgtattgggaaccatttcctcgcggtttgcatataaataccctttgcttgtcaccacttttccatcttctacgatcaatgctgtgccgctgaatccaatgcttttcaaatattgatccaattgagcattatcattttttgtgacgattttgctcttttttgtttcattttgtgttggctttttctttgcttcaggctgtgcctttttttcagttgcttgcaattggttttcctggtgatctcgcataccgcttggaagtgcaagataaattaatccacaaacaaccaaaaaggaaaatatgataagccttctttttgttttctgcttttttcttttctttattcgcgttctgtatgttcttgccatgtcgggtactccttcttttatatgtgacgtatttactgacgcaataaccccttaaaaagtttcttcaaaatgctaatattttcatacatgaactcgaataatgccaaaatttacattttgtttacacttgatcaagaacaaatgttcgtataaaatagaatgtgaggtgagacgatgaataagctgttgtatcgttccatggaagacggcattccggtagaaatcatatacatgaaaaaaagcggtttttctaagcgggcgattcttgtgaaagaaataaaaaacggttatgtgaaagcattttgcttccaaaaacaacagatcagaatgtttaaaatagagtccattttgtccgtgttcccatataaaaaaagaaattcagcccattatgcttaaaagcttcaccatcatcctgccttctttctgtattcccttcctgttttgatattccatcttttgttataatgaatgtaaattcgatttaaagagagcgggcgttttacatctatgcttcagacaatcaataaaacacttggtaagattatgcctttgctgacgcctttaagcgttgtcagcggagtactgcttgcagattatttaaatgggctggcgagtcttgtgccgtggatttttgcgtttatgacgtttgccggcagcctgggagcaaattttcagtcgctgaaaacagcggtggctcatcccttgccgatgtttctcgctttatttgttttgcacatatttatgcctgttttggcatggagcacggggcatcttgtgtttagcggggattcattgacgattacagggcttacccttggtgttgtcattccgacgggtattacgagcatgatttgggctgcaatgtataaaggtaacatcggtttaaccctgtcaattattttagtggacacgattctttcgccttttattgttccattcagtctttccatcttggccggggcgcatgttgaaatggatgtcatcggcatgatgaaggggttagttggaatgattgtgattccttctttattgggaatgctcgtcaatcaattttcaacgccggagcggacagcgcgattaagcgcaaattgtgctccgttttcgaaagtcgggttagccgccgtagtggcgattaacagctcggtggtcgcttcttaccttaaaaacgtcgatttaaagtttttaacgatagccgttacggtctttttggtggcatttacaggctacctgacagcttggctgataggacggctgatgaagcggccccaggaggaaatcgtggctttaatttttactggaggaatgcggaatattagcgcgggcgctgtgttggccactagcttttttccgcctcaagtggcggtgcccgttgtcgttggcatgctgttccaacagattctggccgcgctgtttgggcatttgcttgcaagaagcgagctgaaaaaagcgcatcatttggacaaaaagacgagtctgccctcatagttggcagactcagatcttgcgggagttaaatataatgaaaaccaatagagtaagtgtaatgatctggactttaatctccgcttttctgttttgttctatgatagtcgcagcttcactttctccgctcgctcattcaggccctcatgctaatgagtttggcactttggggatgtgggcggcaatcggaaccgttttgctcttttatatgctgcccctcgctgtttatatggccgggtttgatgcaatgaagtttgtaatggctgttctttgcggaattgggttaatcatcacgctgactatgagtccagtgtttgtgttgattggcgctattggcggaaatgcttctgcattactgggtgtcgcaggtctttgcgttctgttagcgattgtgaatgtgatttggctagtggttgcttttcgccggacgtcagcaagtgcctctttctgatattcaaagttgtgttcaaatttgccaacttcctttagcgatcaggtggacgtttcccccgacgtgaatttctgtgctgttttccgttatttgggcttcaagatgaagcagggaagggcggtttatttcaaatccttgttcagcccttatgctgaggtagtgttgattaaaatagccgtgatgcagtaaataccctgcgagacccccgattgcgcttcctgttgccggatcttcaggaacgctgaaacagtcgcaaaatactcgtgcattgatgtggttttgttcatgatatgtttcggtagtaaaaacgagcagacttgctctgtttctttcatgaaagcttcaaaccgatccttgttgattttgcattttttaactgcatttaacgagtttaacggtacgataaccgctggaagccctgtagaaacctcctgtatcgggaaattcgaatccatatcagatgtgtcgattccaattacccccgccatcatttctttatcaaaggttcggttaaacacgggcggattttgcttcatccaaatgatttgatcagcacctttttcaaacgtcaccggtattgcgcctgctgttacatttaaaatgacattagaagatggttcagtttcgatttcattcttaatgataaacgctgtgcccagcgttggatgtcctgcaaacggaatttctttttccggggtgaagattcggacatcgtacccgccgtttccctgttttcccaatataaaagtagtctcggaaaaattgatttccctggctattttttgcatttcatcacttgataggttcttttctgctttaaaaacagcgagctggtttcctgtatattttgtttctgcaaacacatccacaagataaaaatccatctgaagtatctcccctctaataagacgcagtttcacatatcttacatgagatgggaatgattgaacagtctaatcaaaaataaagaagagcggctcccgctcttcctaataaagcaaatacttctttctgatattcataaaccgtttttgctctgcttcgtattttttggcgatttcatcaattgaagcgccttgctcaatcattgttttgacccatccgttcccgatcagacggttgaaattgcctgaagggaggaactcaaagtcgtccgggtagaggtcatggacggttttgatgatcgcaataccggtatttacaggcttaaaagcggacctgttggtcacgtaaagctccaccccgtggcacagtttattctgatgctttgaaaatgtcggattgaaggaggcggctctgaatctgacgccaggcagcttcagaccgtttaatttttcggcgagctccgtacttttcatgtaaggcgcaccaatcaattcaaatggctttgtcgtgccccttccctctgacatgttggttccttcaattaaacctgtgcccgggtagacgatgctcgtatccggcgtcggcatgttcggggaaggcaggacgaaaggaagaccggtgtcttcaaagaacatctgccgcttccagcctttcatttttatgacggttaggtcggctccgatgttaaattcatcattaaacagctttgccaattctcctgccgtcattccgtgacttagagggacgggatacattccgacaaatgaagaataatccggatctaggacaggcccttcaacttttaagccgttttgcgggtttgggcggtcaaggacgatgaatggaatatcattttcttttgccgcttccatcgcatatgccatagtgtaaatgtaagtgtaaaaccgtgttccgacatcttggatatcaaatagcaggacgtcaacgtttttcaacatctccggtgtcggctttctcgtatctccgtagaggctgtagacggggagaccggttttttcatcaatataagagtcaaccttgtcactggcttgagcgtctcctcttacaccgtgctctggaccatagagagcggtcagctcaataccgggggcttggtgaagcaaatcgatgctgcttgttaatgtcgaattgacaccggttggatttgtaatgagaccgaccctttttccttttaatatgctttttttgttcatgagcacttcaatacccggtgagacctttgcttttttttctttgtccggaaaggcagctgctgcggttagtgtactgaagacaaacattccagcaagcagccagattgctttttttcccatcatgaccctcctttgtgaagcggcttgccgtttttaatattcaatccgtagccatacgggtaaagggtttccccggggcgcgtgactgaaggaatgtctacgggcaatgttcctttaggctttgcctttccgaaaatggcttccactccggccgggatattcggctgcctgaagcgtccgtttgcatagcctttaaagccgtataccgcaatcacggcttcggcttcttcaaaatttgccgtgtcataagggtttctcaggctcattaagacgaatttttttccgttggcctgcgcgtatttcatggcggcgcgcggaaaagcggttgcccacttgcttgagtcttgaatgctgtcatcaatgacaccgtcgttcacaaccggatcgtttttgatgacgtatgatcctgtgatgacataatcggcttcgtcaattttcttttgaatctcttcctcaaacgttttttctgcaaagcggtattcgactaccttgatgtttttccttattttgctgatggtctttgcgattgctgctgtttgctcttcatatggagcgagaatgaggacggtgtccccttttttcggtttaaacggcagggtgcttttgtcgtttttaaggatagtgacgctatcccttgccattttcttttcgtatttcatgtgtttgctgctgccgaccgttttcaaggcgtatttgatttttttctgaagcggttcggagccggtgtgatctatgatgcctcggtctatttttaattgaaggattcgctccaccgactgatcgatttgttccatggggatatccccatttttaacggctgtcagaagagcttcgaatacacgcgccagatttttttcggtctcaagcgatgtgacttgcgcgggcatgagtgcgatgtcgactcctgctttaacagccatgacgacggcttcctcctgtccgaaattatcagaaatggctttcatatttaaagcgtctgttacaacaacgcccttaaagctgagatctttgcggagaaggtctgtcatgacttttttggaaagcgtagcaggcaccatgatgtcctcgccgtcttttttgcttttataggtagtatcgtcaaaggcggggaactggacatgcgctgtcatgatcatgtcaatacctgcatcgatcgccttttgaaatggcgcaagttcaacacttctcagccttttttcattatgcggaacaagcggcaatccgtaatgactgtcaaccgctgtatcgccgtgtccgggaaagtgctttgctgtggcgatcatttgctcgtcctgaaggcccttcatcatctggatgccgagctttgaagtcagctcaggcttggaactgaaagaacggacgccgatgacagggttgtcgggattgttgttgacatcaagtacaggactgaaattcacgttaatgcccagtgatgataattcttttccgatgatttttcctgatctgaaggcgtttttgctgcttctcgatgctccgactgccatattgccggccaggtttgtgcctgattcgagtctcgtgacaatcccgccttcctgatcgatcgtgataaagagcggaatgtcagggctcgcttgttgcaggccgtccgttaaccgtacagtctgctctgtgcctgtgacgttttcagcaaaaagaatgacgcccccgagccggtatttttcaatgattccagcaacttcgtcattcatttctgttaatcctttggcgctcgattccccttttttcttccagtttctaaagtcaggcatcagcatttgcccgattttctcttcaagcgacatgctgctgaccatttgtttgatgttttgttccggacgctgttttgcttctgcttcgcgagcggccggctgcaaagcgagagacgataacagcaatgcaatcaacgcgcattgaagaaatcttttcatataaagggtcgcctcctattggtgatgtaacgcctcgtaaacagctgtaatgacgctgccgtactttccggttgcaaattcatcaccttcgaattgattcgggttttctttagggttgataacaggagagtgctttttattggttaacaacacaatgccgatttgatacacgggatcaatgatagtaaccgttcccgtccagccggtatggccatatgctttgctgctggcgtgcttgccgaacatccactccatatcggtattgccgttgagccgccatcctagtccatatgtgggatttgtttttgacggctctgtaaattgtgaaatgacagaactgctgaatagatgctgtcttccgtaaccgccgccgttcagcatgacttgaaggagcactgctgcgtcgtcaacggtggaaaacaggccggcatgcccagaaacgccttccattgaatagaatgctttttcatcgtggacttccccctgaagtgtgtaagttctgatgtttgggaacgaaatggtgccgtctctggtgtttcccaatcgttccgtagctgcaaaatgcgaccgtttaaagcccttttggagcggattaaacaaagtatgccgcaatccgagaggccggtaaaaccggttttcaacaaaggtatctaaacgctcgtttgtgattttttcaatgatcagcccgaggagcatatagtcgatgtcactgtaaatttgctttgtgccgggttcatatgccaagggggttttcacaagatattcaagcgttttgctccgtgattgagagtagaggtgtccggctgatttcgggtcgtaataattccagcttgcagggaagcctgcgttatgatgaagcaaatcaatcacgcggagccggttttttccctttacatcgtcttccgggtgatctttgaaatcagggagatattgagaaatgtttttgttcaagtcaagctttccggtgctcactaaatgctgcaaggcaaaattgacggcatacatttttgtattggaggctaggtcgaacatcgtgtttgctttcattttttttggatgtttgagcgctatgaggccgttgtatttctgcttgtagccgtagacttcttttttgatgatttttccgtctttaatcaaaataagggcagcgccgggaaagcccgctttgacatcctgttcgatcagacggtccacagctttaagctttttcgaagaaaaaccggcttcttcaggcgttttcgctttcgttaaaacaggatatgtcagccgctgttttgtctcgttcccgatggcagtctgtgctgtggacggaagcggaaaaaagcatgtcagcagcaatagggacgcggccgcactgatcataaactttttcagcttgcttcactcctttctgttaaaaattgcatagtgggaaattttaaacaaacgtttaatcaaattcaactgccatatcgtccttgaaaccaaaggagtatgttaagacaaagccggcagcataggaaataaacaaaccgagaatatacaaaagaacttggtgggtatgaaccaaaaacgacaaagggagccctgatacgcctatcgatacggtcgcaattttgaaatacgcttgaaatgctccgcctactccggccccgaggcacgcggttaaaaacggacgtccgagcggaagggttacaccgaatatgagcggttcgccgatgccgagcaggcctgacggcagtccgccggcaatggctctttttagctttgcttttttcgttttgaaatagatcgcaaaagcggcgcctacttgtcctgcgccccccatggccaaaatcggcagcagcgggtcatcgccgattgaattgattaattccatatgaacgggtgtcagtccttgatgaagtccggttacgacgagcggaaggaaggtggcgcccagtacaaagccggcgataatgcccccaagatctaagatggcgagaagacctgacgtaatggcgtcggaaatcaagccgccgacaggcatgaagacaacgtaggtgacgattcctgtgataagaagggagactgtaggtgtgatgatgatgtcgagtgagtgaggtacaaggcgcctgacccgtttttcgagaaaagcgataaatgcagctgcgaataaaatgccgattaaaccgccgcgtcccggcaaaagcgcttcaccgaaaagtgaaatttcaccaacggcggggttaatgattaaaataccggctaatccgccgagtgcgggggagccgccgaattctttcgccgtattgatccccaccaggatacccaaatacgtaaatagacctgagcctattaccgttaaaataatcgcggtttgtgaggtttccgcgagccagccagcctggataacggctttggtgattccggtaatcaagcctgaggcgaccaaagcggggatcagcggtataaaaatgcttgcgattcgccggagaaacagcttgaaaggcgtcgcgtttttcttggaaatctccgctttatgtttggctgcggattcttttaagtcaacgtgttctgcggatttaagcagcttcccgaactcgtctgatacgtgctgtacaacgcctgtgccgaggataatctgaagcgtttcctcctcaactacgccgatcacgccttcaagcgctttgatcgagtcgatgtcggttttttgactgttgacaggcgtgatgcgcaggcgcgtcatacagtgggtatgatctgcgacgttagacgggccgccgatgtgttgtaaaatcagtcttgccagcccggcatattttttctcatcgctcattttatatcccccttttttacaattcgctaaattcccatcatgcggatggccgcttttgtttgatcaatatactgaatgatgtcctcgtagcgctctgcggccatgcctaaaaacagtaagtcaatcatgtaaagctgagttaaacgagaggaggtggcggcgctgcgaaacggcgcttcatttgagcatgacgtatacagggcgatatcgcttaatgaagcgacagcagactgtcccaaccgcgtcagcccaatggttttaataccatgttttttggcgagcctgactgcattggcgatttcctgtgtttctcctgaatgggatatagcaaacagaacgtcattctcgccggcattggcgattaatgtcgcaacaagatgcatatcactaaaagcggtggcctttttattgatgcgcaaaaatttctgctgggcgtcttgtgcgacgattcctgaagccccgatcccgcaaaaatgaaccgtttctgcgttgatcaatatttgaatcgctttttgaagttcttcgtggtcaatgttttcaaaggtatcgcgaatcgcctgaatcgaattgctggttgttttttgaacgattgaatggagcggctcctgcggttcgatatcccggtatccctgatcagacggcttcattaaatcaccggcgactctcatttttaaatcttgaaagcctttcagccccaaagatttgcagagccgtatcgccgccgccccgcttgtctttgccgaagagctcacctcctgaatggtgccgtttacgatctcgtgggggtttttcaaaatgtattcggcaagctttcgttcagattgcggcaatttgtgaagcatattctgaatgatttccaatcctcctgcagccattgtttcttcctttcttatttaagatttttcataaatggatagggccttttcaatatcgccttctgatttctccagcagtttttctgcagcggctgcatcttcgtttgttttcagcatgatgatggcggttttgacttggttattggacatttccaatgcttgcgccgctgtttcttttggcatacctgtgaccgtttggatgatgcggatcgcccgctcctttaatttgtcattgcttacttttacatctaccatgaggttttcatagactttccccattttgatcatggccgccgttgagatcatgtttaaaatcattttatgagcggttgcggctttcattctcgtcgatccggcaatgacttcagggccgacgactacttctatgctgtgatctgccgcctggctgatcgccgagttttcattgcatgtcagcgatatggccttggcacctgttttcttggcatacttcagggcgcctaggacgtacggagttcggccgctggcggcgattccgattacggtatcattgtttgagaggttaacggcttctaaatcccgtctgccaaaagcctcatgatcttcagcgccttcgacggcattgtacaaagctttttctccccctgcaatgatgcctatgaccgactcgggagatatgctgaatgtcggcgggcattcagctgcatcaagtacgccgagcctcccgcttgtaccggcaccgatgtagatgatccgtccccctttctttaacgacccgacggcgtagtcaacggcggtcttaacatcgggcaagacttcttgtacagcttcggctaccgttttatcttcatcattcatgattttcaacatatcgatcgtttctgcctggtgaatgcgcttggatctttcattgcggcgttcggtcgttaaggaacctaaatggctgttttccatcgacaaatcctcctgatcataaaatgcatatatttcttaattttcagtatattatggctggaatataatttcaatgacaaaagataaatattaaaattttgtttcaattaggttctaaacatctgaacgccgaaataaaataaagcgcagatgaactgcgcttatgtcctggtactacagctcgtctatttgatgttcggaaatcacacggaagccttcttttttcagaagtgccgacgtaaggccgttgccggctatttttttgcttgagaaacttccatcgtatatatggctgctgccgcaagacgggctgttttccttcagcacgatcgtatcagccttgatttgccttgccatctccaatgtttgatatgccccttttatatataggtctgttacgtcatttcccgattgtgtcttgatcaccgctttgccgtctaaaacgtcttctcccgtcccgcctataatttcggccggttcccttggtgtttgaaatccgccgagcagctcgggacaagccatcaccgcttttttttcttcaacgagcttattgattttttcgacatagctgtgcgaaccgttatagcggcattccactccggccagacatgaacttaccagtatcattattcggtcccctctcttgcacatcagatagccctattttaaacaaaatttccgcgcttttctcaatctctatgaataaaaaatttgaaaataaaaattttaatttacctctttacaaatggggaggaacctgtatataataacttttgtcagctttacgagagctgcttgaaacacggtgatggcccgttggtcaagtggttaagacaccgccctttcacggcggtaacacgggttcgaatcccgtacgggtcaccattcttttttggacggcacgctgggaaaaggaaggcatgctaaaagcgcaacgtcctgttgcaacgcatgcacttgtacgtcctgtacttcggaggattagctcagctgggagagcatctgccttacaagcagagggtcggcggttcgatcccgtcatcctccaccatttttcgaagcggttttagacacaaccgcgccggtaactgcataagataccgtatcatgccggtctagctcaattggtagagcaactgacttgtaatcagtaggttgggggttcaagtcctctggccggcactgtttttggaggggtagcgaagtggctaaacgcggcggactgtaaatccgctccctcagggttcggcggttcgaatccgtccccctccaccattattgggctatagccaagcggtaaggcaacggactttgactccgtcatgcgctggttcgaatccagctagcccagtttttggacatcctgctcggatgtcctttttattttgtcttttttgtataactattcaaaaaaatgtcttgttgagtcaattccgaatcggaaggtacaatgaaggtctgaaagggggatatcatatgttaaaacagcagatttcaatgatcggcgtgccgatggatcttggacagctgaggcggggagtcgatatgggaccgagcgcgattcgctgtgcaggtgttaatgaacggctggaatgtctttgtcaggatattgaagacctcggcgatatgacgatcgggcaaagagaggatgagaaagaaggcggggagccggcatctgaagagctaagaaatttgaaagcgattacaaaagcgagtgtaaaacttgctgagactgtcgataatatcgtagcttctggcgcttttccgctcgtgctgggcggtgaccacagcattgcgatcggaacgcttgccggccttgcgaagcattatcaaaacctgggtgtgatctggtatgacgcccatgccgatttaaatacaaaagaaacgtctccctcaggcaacattcacggcatgccgctcgccatcagcctgggaatcggccacgaagggctgaccgccatctatggaaaagaagctaaaattaaagcggagaacatcgtcatcatcggtgcgaggtcacttgatgacggggaaaaagaattgattcgcgacaaagggatcaaagtatatacgatgcatgaaatcgaccgcctcggcatgacaagggtgatggaagaaacgatagactatttgcgaggcaggacggacggtgtccatctgtcactcgatttggacgcgcttgatccgaacgatgcaccgggtgtcggaactccggtagcaggaggcatcagctacagggaaagccatctggctatggaaatgcttgaggaatcgaagctgattacgtccgccgagtttgtcgaagtaaacccgatattggatgagaaaaacaggacggcggaagcggctgtagccttaatgggatcgctgtttggcgaaaagctgctttaggtgcagttgaagagcggcttcaggctgctcttttttatgatagaagtctcaacttcataatatttatgatgtataataattttaagctaatattaagcgcatgaaccctgtcaaagcatctacaccctgccaaaaatttgataaactatttttatgaatttaatgaaaccttataaaaaccaattcgtatacataaagaccggtgaaggcagaggttagataaatatggaaacaatgattaaaaaaagaatcaaacaggtgaaaaaaggcgatcgtaacgcatttgcagacatcgtggatatttacaaagacaaaatttatcagctttgctaccgtatgctcggcaatgcgcatgaggcggaagatattgcgcaggaagcgtttatcagagcatacgtgaatatcgacagttttgatatcaaccggaaattttccacatggctttatcgaatcgcaaccaatttgaccatcgatcgtatccgtaaaaaaaagccggactattacttggatgcagaggtggcagggactgaaggactgacaatgtattcccaggttgcggcggatgttgcgcttccagaggatgaagtggtttctttggagctgcacagcaccatccaggaaaaaatcttaaggcttcccgataaatacaggacggtcatcgtattaaagtacattgatgagctttcactcattgagatcagtgaaatcctcaatattcccgtaggtacggtgaaaacgaggatacacaggggcagagaggctctcagaaaacaattaagggatctttaagtggggtgatgaaatgagctgtccggagcatattgttcagcttatgcataaataccttgacggagacatacttccggaagatgaaacgcgtttaaaagagcacctccaatcatgcgaaggctgcaaaaagcaccttcatgaaatggaaaaatccatcgctcttgtccagagcacgtcgcatcttacagctccggcgaactttacagccaatgtgctggcgaatctgccgaaagaaaagcggacggcatcgatcaacaggtggcttaaagcccatccgtttttagtggcggcggctttatttgcaattttgatgggcggcagctttttctccagctggaaaaacgatcacgatttcagcgtatccagccagcctaatcttgtggtgaaaaacaacacggtcatcgtgcctgaaggcgaagttgtcaaaggcgatgtgaccgtgaaaaacggaaagctgattatagagggcaaagtcgacggcgatgtcacgattgtaaacggtgaaaaatatacggcttcagcaggacaagtcaccggtcagatccatgagatcaacgaggtgttcgactggatctggtataagatcaaatcgaccggaaaatcggtttttggtgtgaaggagtctaaagagtagagcaaagcgggcgaatgagctttgctctttttttatgaggggccgccatttcacttggaaaatcaatttgtgctataatagcccctgtatatataaaaataatagatcataccattttgaaacatattaaccttactaatgactgaattcttggaggacgaggaaatggcttttgaggatatccctttcttgcagtacctcggcgatgccgttgatattctccttgtttggtacgtaatatataaattaatgatggtcatccgcgggacaaaggcggttcagcttttaaagggaatcgtggtcattgttctcgtcaggctggccagtcaatatttaggattaagcaccctgcagtggctggttgaccaggcgatcacatgggggttcctggcgattattatcatcttccagcctgaattgaggagagcgctggaacagctggggcgggggcgctttttttcgaggagcggaacacctgaggaagagcagcagcagaaaacgattgatgcgattacaaaagcgattaaatatatggcgaaacgccggattggcgcgcttctgacaattgaacgggagacgggaatgggcgattacatagaaacggggatccctttgaatgcaaaggtcagctctgagctattgatcaacatctttattccgaacactccgcttcatgacggagccgtgattatgaaaaacgatgaggttgctgcagctgcctgctaccttccgctttctgaaagcccttttatttcaaaagagcttggaacgaggcacagagcagcagtgggaatcagtgaagtgaccgacagtctgacggttgttgtatccgaagagacgggcggcatcagcgtcgccaaaaacggagaccttcaccgtgatttatcggaagaggcattgaaaaatatgcttgaagcggaatttaagaaaaattcgcgggaaacttcctcaaatcgctggtattggagggcgaagaaaaatggataagttcttaaacaatccctgggctgtcaaagttgtcgcgttattgttcgcgtttcttctttactttgcggtccacagcgctcaggcgccgactccgaagaaaccaggtgaatcgtttttcccgacatcgacaacagacgaagcgacgctcaccgatataccggtcaaatcgttttatgatgatgaaaactacgtcgtaacaggcgtgccgcagacggtgaatgtcacgattaaaggcccgactggaaccgtcaagaaggtcagacaagtgaaggattttgagatttatgccgacatgcaaaacctgaaaacaggcaggcataaagtcgagctgaaggccagaaatgttgccgacggcctcactctgaccatcaatccatcggtgacaaccgtgacgatcgaagaaaaaacgacgaaggaattcccggtcgaggttgatttttataataaaaacaaaatgaaagacggctacacgccggagctgccgatcatcaacccgaaaaacgtcagcgtcaccggctcaaaagccgtgatcgacagaatccagaacatcaaggcgacgatcaatttagagggcgtcgaccagacggttgaaaaagaagccaagcttacagtatacgacaaggacggaaatgtcctgccggttgaagtcagcccttccgtcgttaaaatcaccgttccggtgacgagcccgagcaaaaagattccggtcaaagttgaccggaaaggcagccttccggacggcatcagcatttccagcctcgatataagtccgggagaggtgaccgtctacgggccgcaaaatgttcttgattcgttagaatttgtcgaggccgacgagattgatttaagtaaaataaaggatgatactgaattggaagccggcattaaagtgccggacggcgctaaaaaggtgtcacccgaaaaagtgaaaatccaggtgaaagttgacaaggaagaagagaaaaaactgaaaaacgtttcaattaaaaccgcggggctgaatgacagccgggatcttgaatttctcgatccgaagtcaggcaagctggatatcacggcaaagggctcgacagccgcgatcgaaaaactccagccttccgacgtcgagctctatgtcaatgtggcggatcttgatgacggcgagcacaatataaagctggaagtaaacggtccgcagaacatgacatggtcgctgccgcggcaaagcattcgagtgaaaatctcatctcaaacaacccaaaacgaaaaaaacaatggtcaggatgaagaagaagagaatcattctgaaaaggattcacaaccttcatgaatcaaaaaggagcgatattaatgggcaagtattttggtacagacggtgtaagaggcgtggcaaacagtgaacttacacctgagctggcctttaaagtcggacgctttggcggatatgtcctaacaaaagataaggagcgtcccaaggttctgatcggccgtgacacgcgcatttcagggcatatgctggaaggggcccttgtagcaggccttctttcgataggagcagaagtcatgcgtctcggcgtgatttcgacgcccggagtcgcatatttgacgaaggctatggacgcggaggcgggtgtgatgatttccgcttcccacaaccctgtccaggacaacggaattaagtttttcggcggcgacggctttaagctttccgatgaacaggagcttgaaatcgagcgtctgatggatcagccggaagatcacctgccaaggcctgtaggcgctgatctgggcatggtgaacgactactttgaaggcggacagaaatatttgcagtttcttaagcagtctgctgatgaagacttcacaggcattcatgtcgcgcttgactgtgcgcacggggcgacatcttcgctggcgacccacctgtttgccgatcttgacgcagatgtatcgacgatggggacttctccgaacggattaaacatcaatgacggagtcggatcaacccaccctgaagccctggcagaatttgtgaaggaaaagggagctgacgtcggcatggcgtttgacggggatggcgaccgcttaatcgctgtcgacgaaaaagggaatatcgtagacggcgatcaaatcatgtacatatgcgcgaagtacttgaagagcgaggggcgcctgacggacaataccgttgtctccacggtgatgagcaacctcggtttctacaaagcgcttgaagcggaaggcattaaaagcgttcagacagcggtcggcgaccgctatgtagtggaggcgatgaaaaagggcggatttaccctcggcggagaacagtcgggacacctgattttccttgattacaatacgacaggcgacggactgctttctgcgatcatgctgatgaacacgattaaaatgacaggcaagccgctgtctgagcttgcggcagagatgcagaagtttccgcagctcctcttgaatgtgaaagtaaccgataaacataaagtaacggaaaacgaaaaggtaaaagcggtcatcgaagaagttgagaaggaaatgaacggtgacggccgcatccttgtgcgcccatccggcaccgagccgcttgtccgtgtcatggctgaagcgaaaacgaaggagctttgcgagaagtacgtaggccgcattgcagatgtcgtgaaagctgaaatgggagcagagtaattttccgcagaagactgaagaacgagacatgctgatttcacataagataaagggaaccgttcaatcttggaaaaaatgtgaaccattttgaaaaatgtttgacggttcctttagcgtatagtaaaatcagcttgtcttgtttaatttataaggaaaggcagggcagaaaaatttttatagttatagcgcccggactaagcgtacggatgaaacagcttagttgacgaggatggaggtttatcgaattttcggcggatgcctcccggctgacctcaaagatcacagccgcaaggatttcctcaaaccaaagaggcgactctttgaacaaagggaaattgcatgatcttccataaaaaacatgtaggaggggacgatgaaagtccccgcctgacaagcagactttcttcgtctcctgcctgcgactttaggaggaagaaaattatgtgtggtattgtaggttatattggccagcttgatgcaaaggaaattttacttaaaggtttggagaagctggagtatcgcggctacgattcagctggaatcgctgtagcgaacgaagacggcgtacacgtgtttaaagaaaaaggacggatcgccgatcttcgcgcagccgttgatgcaaacgtgaagtcacaagcgggaatcggacacacgcgctgggcgactcacggagaaccgagccgtctaaacgctcatccgcatcaaagcgcatcaggccgttttacacttgttcataacggcgtcatcgaaaactatgttcaactgacgcgcgaatatttacacgatgtaacccttaaaagcgatacggatacagaggttgtcgttcaagtgatcgagcaattcgtcaataacggccttgacacagaagaagcgttccgccaaacgctcatgctgctcaaaggctcttatgcgattgcattattcgatcatgaaaacaaagaaacaatctatgttgcgaaaaataaaagcccgcttcttgttggccttggagacaatttcaatgttgtcgcgtctgatgcgatggcgatgcttcaagtgacaaacgaatacgtggagcttatggataaagaaatggtgattgtcacagacaaaaaagtcgtgatcaaaaacctcgacggagaattgatgtcacgtgcctcatatattgcagagcttgatgcgagcgatatcgaaaaaggcacataccctcactacatgttaaaagaaatcgatgaacagccgcttgtcatgcggaaaatcattcagacgtaccaagatgaaaacggcaagctctccattcctggagacatttcaaacgctgttgctgaagccgaccgcgtctatatcatcgcctgcggaactagctaccatgcaggtcttgtcggcaagcaatttattgaaacatgggcgaaagttccggctgaagtccatgtcgcaagcgaattctcttacaatatgccattgctttctgagaagccgctgtttatctttatttctcaaagcggagaaacggctgacagccgcgcggttctcgtacaggtgaaaaagctcggacacaaagcgctgacattgaccaacgtaccgggatctacgctttcccgtgaagcggactatacgcttttactgaatgccggccctgaaatcgcggtagcgtcaacaaaagcatatacggcgcaaatcgccgttctcgcaattttggcagccgtgactgcggaaagccgcggcaaagaactcggctttgatcttgtcaaagagctcggcattatcggaaacgcgatggaagccctttgcgaccaaaaagacgaaatggaaatgatcgcccgtgaatacttgaccgtaacacgcaatgcatttttcatcggccgcggcctcgactatttcgtctgcctcgaaggatccctgaagctgaaagagatttcttacattcaagctgaaggcttcgccggcggcgaattgaagcacggtacgatcgcattgatcgaagacggcacaccggtcatcgcccttgcgacacaggagcacgtcaacttaagcatccgcggaaacgtcaaagaagtgacagcccgcggcgccaacccttgcgtgatctccctgaaaggcctggaagaagcagacgaccgcttcgtcctgcctgaagtgcatccggagctcgcaccgctcgtctccgtcatcccgctgcagctgatcgcatactacgcagcgctgcaccgcggctgtgacgttgataagccacggaacctggcgaagagtgtgacggtggagtaggagtcggttgaaataaaagtttgtacccctcttggattggatgatctggaggggtatttttatgtttgaaagaggaataagtcttatcaaaaatcgaagtgcgctagattgtaagtgaagcgcacagcggaatgccggggcggtttggacgatgctcgtatatatacttatcttttaaggaagtgtaaccatgaacaatgaaacgtacattgaagttaacagaacatcgcagcttatgaataaaatgagaaaatttacagtgctgattgatggtgtcgaggctggaaaaatcaaagatggcgggagactgcgaattgatttggagcctggcgaacatgagatccaagtgaaaattgattggtgtgtaagccaagctttgaggtttactttagatgaaggagaagtgttaaagtttagatgcggaagtccggttcgtgggtggaagatgttcttcggacttttttatgtattggccgatccagagaaatactcgtttattgaactggaagaataggcgattgaaagacggccttggtcttcatcatccccatcaaacgctgcaccgtaacaacctgactaggagtgtgacggtgcagtttttttatccgaggatgaatatgaagcggtgtcaatgatggaaaaaagccctatcctatttaaaacactttatttctataaatccgaatcgacagaagccatgaacacccatacagcgtaataattgatatggcaacgatcagatagagaaaagtattttgtaaggttagaagcatgtgaatgaactctctaatttgatcgttcaaattttggacgagaaagttaatcgttagcatatataagccaaatgcagcaatagaagcaatcacgagatagttgcttttgaatttataacagaatggcagcatgaatgaagcagctgtcatcacaatggcaaccattagcaagatgtctttccagatcgtaaattcccggtgaatgatgaagtgtacgataaatatggctgcagccaccatagatgtaaagagaacgacgacaatatactttgaactgacaatctctttccgtgtataaggcaaagaattgagaagcatatgtatagaagacttttcatctattgaaaaggcatacatcgatataactatactaaatacaaccccaacccagattggagaaatatctaacattaaataaacacataataccaaaaacgaagccgccaatgtttttttctgcaagataatatctttaagaattaagttgaacatgttctttggctcctttcttcgtatagaacataatatcttcaagggtcggtttttctattaacgccatgtccccaaagattttttctgttcgtgatttattcgcagtcaatgcttcaaatccatgagttgattttcgaaccgctataaattcctgttcggtctcccggtctaacaactccattccgccttttacaattgcatattgttcctcaatttcgtaaaagtcctttgtaaagatgtgctctcctttatcaatgaacgtgatataatctgcaatcttatctaaatcagttgtaatatgagtcgaaaaaaagatcgtcttatccccatcttgcatgagctgatgcaagatttccaacagctcccggcggaaaatcgggtcgagtccggacgtcggttcatccataataattaattccgcatgatgggacaaagcaacggttaatgatgctttcattatcatcccttttgagaacgtcttgattttttttgtgagcggcaagttaaatgtgttcacataatcattaaatacttgttcatcccaattgacataggatcttttcacaatatctttcatttcagctaacgttaaatgttcataaaatatgttggaatcaaatacaaagccaatacgttgtttgatttctttctcatgctccttgtaattcatgccaaataccgtaattgttccgctgtcaggctgcaataagttcatgatcagtttaatcgttgtcgattttcccacgccatttccgccgataaatccggtgataaaacctttttttacattcatcgaaaagtccttgagctggaaaccatcgaacgatttatgaacatgccggagttcaattacattgtccatcattcttcctcctgatataaaatggtaagcaagtcttttaattctgtaagggtaacgcctatgtctttgctgttttttatcgctgccgacaattgctcttcaatggctttcatttttccttctttcatcatttcgtcattctgatctgatacaaaagagcctttcccgactacggaataaatgaacccattcttctccagttcttcataagcgcgctttgacgtaataagactgacattcatgtcctttgccaattggcgcatagaaggcagcggctgtccgggtttcaattcattcgcaagaatttgatccttaatttgggtgtaaatttgttcataaatgggttgctttgaactattcgaaattataattttcattttaaaccctcttttgtttatatacaatatacacaatatgtacaatatacacaaagattgcttgaatggcaacgatttttttattctttggggagtgaattgtcagccagaatttgatgttaagaataaaagggcacaacacatatttacaatttgcgatatgaagatataatgattggtatggaacctattgaaattttcaaagctttatcaaatgaatcaaggctgcaaattttgcaatggctgaaggagcctgatcgtcattttaagccccatgaagggattgatatgaacacaatcggggtgtgtgtcagccaaatcacggacaaattgaaaatgacgcaatcgacggcttcccaatatctcgcgatccttttaagagccggcctgattaaggcggagcgaatcggaaagtatacgtactacaaaagagacgaagaggccattggaaagcttgctgactttcttaaaacagagatatgatgagcattaaaaaataaacatctcttgatgatgtttatttttacaccatacatatcgacatattccgatgtgtttattttttaattttacatatcgttatttcgtgatatgtaaatgtataatgtgataaaggagcgaacgataatgtttagtacatggaaaatttatcttttagcaatcatcagttttttggtagggacctcagagtacatcatttccggtattttggatcagatcgcccacacactcgggataactttagctgcagcggggcagctcattacgatcttttcactggtgtatgctgttttcaccccggtcctgatggcgttgacggcaagtatggataggcgcaagttaatgatgtatgctctcggtttgtttgtgataggaaatattttggcttttaccctgcctggttatggttggtttgttgcagcgcgtgtcgttatggctttgggggcaggcatggttgtggtcacggccttaacgattgccgccaagatcgcaccggcgggtaagcagggcagtgcaattgctacagtcgtcatggggtttaccgcttctttgattataggtgttccactcggaagaatgacggcagaagcattagggtggaagtctgtatttgggggaattgctttattgggattcatcgcaatgattgttctattcttaacattgccgcatactgaaggcgataagcccgtccctttgcttcagcagctttcccttttaaagaaacggaaagtagcgatggggttatcggtcacttttttctggctcggaggatattccgttgcatatacttatctgtctccttaccttctgaccgtttcagggatcagcggcaatttgctcagcggcgttttgcttatatttggaatcgccagcttggttggatcgaagtttggcggatatagcactgataaatggggagttccttttacgctcgttggcgggatggcgctgcatatcatcgcactgattttgctgtcgcttgtcacccattcctatgtcggagtactgttgattctcatattatggtcgttcgccgcatggtctaccggcccgacgcagcaatatcacttagcgacgcttgaacccgaattgtcaggtgtattgctcggcatcaatcaatcgatgatgcaattcgccatggccgcaggtgcaggaatcggagggatttttgtagaaaaagtgtcgctggcttctattacgtggtttggggcattgggggttatgattgcgattgttgttgttttgacgaccttcagttcacggaaagcagcacatgtaagagaaatcagttcataatagccttgattggtgttgaagattcaagggtttcattcgtcatatcttacctgcttttttgagcctgacaggcagcgctgagccgaaaaatctagcatccgctcgctgtaaaacgagcggatgtttttttactcagctaaaatccgcaaataagctttccaaggtccgacatcatcctgataccgcttcgccagcactcttgcgatttgcgagaggtgagtgagatcgtgggcaacccaagttgagatctattctctaagcttgacgattccaaactccgggtgcatccccgtttgttcgaagtcggtttcaggatcaagaatctgccgcaatgttttcagattcgcccgtctgatttcagcaaattcgttaagcagctgttcaatcgttttcccgtcgttttgattcaactggctgaagcggtcgaacggcggaaaagtttccgttgctccttttgtcacgatcattttgattcggggcaaccagttgtttttttctccctcaatcagatggccgactacatcaaaggcgttccaagtgtcttcgccttcatcgcagctgatccaggggtttgataatccggtcagcagctgactcaatgtttgtggtgtgcgctccaggatttcgatggcttcctcgagttgaaagttcatgtgaatgacctcctccttttataaaagatcacgtcaactgccgctcagcaaactcccgatacagcgcatgcgaagcaatcagctcatggtgccgtccccgccctgtaatctcgcctttttcgataaacataatttggtccgcgttcacgattgtcgatagccggtgggcgatgacgaaggtggtgcggccttccatgaggcgggcaagcgcctgctggacgatggcttctgattggctgtcgaggctggccgtcgcttcgtccatcattaaaattttcgggtcgcgcaggaaggcgcgggcgatggcgatccgctgtctctgtccgccggacagcttgacgccgcgttcgccgacttctgtatcaagctgctcagggaattgtttaataaatgtatcggcatacgccatttccgcgactttccacagttcttgatcatcaatgctgtcggcgtgatccaagccgtagcataagttctcacggatggtgccggacatcatcgggctgtcttgagatacgtagccgatctggctgcgccacgatttcatcgacagcttgctgatcggtgtttccccgatgttaatggctcctgagtccggttcgtaaaatcgttccaagaggccgaacatcgtggtttttccgccgccgctcggaccgacaaacgcaatcatctgcccgggatcgacgtcgaaagataccccgcgtaagaccggctcgccaccggcgtaagtgaaagttacattctcgacatgtatcggcagattggagatgtccatctcaagcccttcctggccttcttcctcttcagaatgcataatctcgatgatccgctctgttgccccttttgctttttgcagctgagtgaaaaacattgtgaacgatgtgatcgggaaaatgatttgaaacagataaagcaaaaaggcgatcagcgagcctgccgacatcgtcccttcagagacgcggatgccgccgtagccgatgatggcgacgatcacaatcataatgacaaggtgcatgaacggggagacgagcgcgaatatccgagcttccttgaggccgtattgaaagagctttgaaatgcctgataaccctttcattttttctgtatgctcggcgtttgatgctttcatcaatctgatttcgcttaatgtctgctggacatgtccggtgaaggaagctgtttcatcctgcattgttttggaaatgcgctgcattttcatgccgagcgggatcatgatgaaggtcgtgatcggaacggagatcagcataagaagcgtcattttccaatccatgatcagcagaatgaccacagatccgacaatggtgatgattccggaaacaaactgcggaaaatggtcggaaatcaagctttcaacaatgccggtatcattgacaactcggctgacggtttcgccgctcgtcttttcgtcaaagtagcggacaggaaggcgcagcagcttgaaccacatgcgctcccgcagggaagcgaccactttctgcccggcgtaagaaagaaaataggtcgaaaacccgtcgcagaccgcttgaacgataaaaacgagcgcaaggattcccgataaggccagattgatcgaattggcggaaaagccgtcaaccatttcccttgtcaacagcggaatggacaagccgaccaaagtcgtgacgaggcttgcggtcaaaccggcgcttaaagccagcctgggtacgccggatgtgagaatcattgagaaaaacggtttcatgctattgttgttttctgttttcatttaataaactccttatcgatataatgtcaaagaagttgatggcgcaagctgtaacgcatcataatacgatatagacagctgaaagttcccgatcattgccgattttaactccatactaaaagtttgacagatgacataattgtaactattattgttacatatagttgattgggtgacaagaaaggaagaaaaacatgacaataaatattaaagtatattccgattatgtctgtccattctgttttctcggaaaagaccagctcgaaaaagcgatcgaaggcaaagatgtggaagtcgagtggctgccattcgaactgaggccgcgcccatcggagcagcttgatccgttaaacgacccggccaaattggcgatgtgggacggcgccattaagccgcgaatcgaggcttggggcgtcaatatgaagctgccgaacgtctctccgcatccttatacagatctggctcatgaaggctatcacttcgcaaaagaacacggtaaagggaaagcgtacaatgaccgggtttacaaagcgttttttcaggaagagcaggatatcggcgacatcgacgtattaacgtcgctggccaaagaagccggactggatgaacatgcttttaaagaagctttaagcgcaagaacatatcaggacgtgcagcggaaggcgctccaacacgcttacgaagaagccggcatcacggccgttccgacttttatcatcggcaatgagcggattgccggagccgcggcgaaggaagtgtttgaacaggcgatcgaaaaagaaagcagacaaaaacctgttgacggcttgcagtgcgatcttgacggaaacaactgctaagcaggaaaaatgagcgatttgaagaaccctttaatagggttcttttttataaaggaaagaagagggaagacagttgacacttcatcattttattgcagccgatcgggagcttccgctggggagcttccgagaccaaacagaagaaggtttgattagcatcgttaagcttgatccaggatacgaaatggtcaaaacaaaactcagcaagccgtttgtatatgaggcaaccggctgtttacatagacccggaaatgacataagggcgctattcagctatatcaattcaaatattcccgagggtgaagatatagaagtttactcttgctgggacggtgaggaagacaaagaaaaagacgaccgcttagactttttcattgatatagagaaccttcagctgggcaagcatgtcaagctggataaaaagaaatacatcgatgaaattgcctgttttatttcgaggagcggcagctggtcaagattcgcaaataaaacacttgttggcacagggttttcacggtttttttcgccgtttcatttagatatccaatcaaggaggaatcaagatgtccgatcacaaagcggtacacagcgttcaagcgaaagcggaggggaaaactctggtcatggagcggagtttcgaggcgccacgggagctggtgtttaaggctttttctgggtcagtgcatttggaaagctggtgggggccgaaaggatggcagactgccaacagcaggtttgagtttcagccggatggcgtatggctttactgtatggaatgcagagatcaaaaccaaggcgaattctatggccggaaatcttgcggcaaggctgtttttcaagagattgcggcgccggaaaagatcgtgtacacggatatgtttacagacgaggaagggaatgttgttcccggcatgccggagattttgaatgaggtttattttcaagagcgcgacgtggggacaaaactgattacacgctcacatttttcttctccgaaagagcttcaacagctgctggataaggggatggtcgaaggcttttcttcacagctggagcgccttgaagactacctgaaagccattcgctaaaagaaggaggacatgtcgatgacgtttttagagcatttcatataaccgtgtattcgcggacctcctcatcaagatttactacaacaatcaaaaagaggaggtatatacatgcgtacagagcaggaaatcatcgatttggtgctgaaggtcgcacgggaggacagccgtgtcagagcggtcggcatgaacggctcgcggacgaacccaaacgtcccgaaggacccttttcgcgattatgatattgtctatgttgtaacagatatgcagtcttttctcgatgagccgggctgggtggacgtttttggagagcggatcatcatgcagacgccggaagcgatggagctgtttccgaatgagcttggcaaccgcttttcgtatttgatgttatttacagacggcagccgcattgatttgattcttgtgccgcttgaagaaaagctggaatatagcagggaagacggcttgaccgtgatcctgttggataaggatcaggatctgcccgtcatcccgccgccgacggatcgggaatattgggtgcaaaaaccgtccccgcaatgcttcgccgactgctgcaatgaattttggtggacatcgacatatgtggccaaaggcttgtggcggcaggaaattctttatgcactcgatcatttaaatctcgtcagggccatgctgttgaaaatgctcgaatggaaggtcggctttgaaacgggcttttcgctgagcataggcaaaaatgcaaaatttttggatcgctatgttgatcaaaatacgtgggaaaggcttttggagacgtatccgccagctgattataagcgggtatggaacagtttgtttaagatgtgggagctgtttgaagagacagcagcagcagttgctgaacatctgaatgaacaataccttttcgcagaagcggagaaagtcagacagtatctgaggcgcgttcagcagctgaaacctgatgcaaaggaaattgactaatcaaatgatggccgcactcccggcaggtgagccgggagtgcgttttttgcggaggtgaacggaatgttcagtattaaaaaaatgctgcagaaccattatggaatcgacagtgtgaacatttctcccgagcaaggcgggtggacagcacttgcttatcaagtaaccgacggtgaagcggctttctttttaaaagtgtatgataaaaatagggcatcgacagcgaaatgggcagctttaatcgatgattacatccctgttctggggtggctgggggatcacaccgctctcaacgggaggctgcctgtgccgcttttgacaacagctggagaatacaagtgtgaagatgacgatgcggtgtatatgctttatgaatacattgccggtgaaaccattggagatcagccgctcggcaaagggtgcgtggagaagctcgccggaatcatagcggagctgcaccgatatgatgagacgatcccggtgaagacagaaggaattaaagaaaaatatgatatttcgtttttagatgagatgacacaatggcttgatcacctgccttgtgagctggcgacactcattcaaccctacagcggagcaatccgcgatatgatggagtcagccttatccctggcggatgatttgaaatgcagcggcagaagattggctttgtgccatacagatgttcatggctggaatttgatgaaaacgggcggggaattgattctgatcgattgggagggcttgaaactggcccctgttgaagcggatctgatgttctttgctaaccagccgtatgctcaagagtttttgcgcgtttactgcgagactcataaaggatttgaaatcgatcagaacgctttgcggttttatcagatcaggcgaagactggaggacatatgggagtttacagagcagctggcgtttgacattcaggcagagaaagaaaaggcagagacgatgagcttgctgaaaaacgagcttgaagccataaaagacagcaagaccggctactaaaatgctaaacggaggaacactcgtgaaaaattatcgtactttattttttgatgtggatgatacactattagacttcggtgcggcagaaaagtcagcattgcgaatgctttttgaggagcagcaaattcgtttgacagctgaaatagaagcgaattataaacgaatcaatcaaggtttatggagggtgttcgaaaaaggggagatggaccgcgaccaagtggtgaacacacgcttttcccttttattcaaagaatatggtcttgaggctgacggcgttttgcttgagaagaagtatcgcagcttccttgaagaagggcatcagctgatagacggcgcttttgaattaatcaaaagcctgcgggatcaatatgatttatatatcgtgacgaacggtgtttcaaaaacgcagtataagcgcctgcaagcttcaggattgtacccgatgtttaaagggatttttgtttcagaagacaccggttttcaaaagccgatgaaagaatactttgattacgtttttgaacggattcctcatttttctgtcgatcaggggctgatcatcggggattcattgacagcggacatagaaggggggcggctggccggattggatacatgctggatgaatccgggcatgatagcaaatgacactggtattgtaccaacctatcaaatacaaaaacttgatgagttgtattatattttaaacattgaaaaagaatcggccgccggccattgtttataaggaaaaacgggcgcattttgattggttattcaagatgcgtactgctttttgatattataagaatattctttatattgggatagttgtttcttaataaatagatagagtaaaatttgttctcctggaaaaaacaattgtatttttggaaggagtttattatgatggaataagtaaattttgagatatatactaattgtaattatcagatttttattactacttaatacgatgaagatgctttgtcatcatatagttttttgggtgacatcagccgtgtaagaggaggaaaagaagtggcgaacaaagaattgaagagaggcctgggcgcgcgccacatccaaatgattgcgcttggcggcactatcggcgtcggtttatttatgggatcttccagcacgataaagtggacaggaccttccgtcctgcttgcttatgccatttgcggaatttttatcttttttattatgcgtgcaatgggggaaatgctatatgtagagccaagcaccggttcatttgcgacattcggccatcaatatatacacccgttggccggatatatgaccgcgtggagcaactggtttcagtgggtgattgtcgggatgtccgagatcatcgccgtcggggagtacatgaagtactggtttccggatcttcccgcttggataccgggcattatcgcaatggcgattctcggaggagcaaaccttgtctctgttaaatcatttggtgagtttgaattttggtttgcgatgattaaaatcgttacgattgtattaatgattgcagcggggttcgggattattttcttcggattcggcaacggcggacaagcgatcgggttttcaaacctttggtcgcacggcggtttctttacaggcggattctcaggattcttctttgcgctgtcgctggtcatcgccgcttatcaaggggtcgaactgataggaattacggcgggggaggcaaaagatccgcaaaacacgctgagacacgcgatccaaagtattatttggcgtattttaattttctatattggcgccatcttcgtgattgtcacagtctatccttgggatgagctgaatgcaatcggtagtccgtttgtatccacttttgcgaaagtcggaattacggcggcagccggcattattaacttcgtcgtcatgacggcggcaatgtccggctgcaacagcggaattttcagtgcgggccgcatgctttatacattgggagtaaacggccaagcgccaaaattctttacgaagatttccagaaatggcgtgccgttatacgggacgattgccgtcttgatcggtttggcaatcggcgtcgttttaaattatattgcgccgcctaatatttttgtgtatgtatacagtgcgagcgtgctcccggggatgattccgtggtttgtcattctgctcagccatatcggattcagaaaagcaaaaggagctgaaattgacaaacatccgttcaaaatgcctttcgccccagtgacgaactatttgacgattggtttccttcttatggtattggtgggcatgtggttcaacaatgacacacgcgtgtctctgattgtcggggttattttccttgcggttgttgccgccagctattatgtgtttggaattggcaagcgtgcctcagctgatgggaataaataatgaaatttttaaggcgcttggggctgtcgagatgttattggcagccctctcaggcgctatgatcaagaaccagctcctggttcttttttttataagcttggctgtgtttcaatacgggcgccaatgatgggcggaaacccgcccgctccggagagcctctggggtccatttcaaacaacgggtccgaaagatgttgtgtttcaagtgaagccaagccacacagtaaaggcttatgaaaaggtataagggaggtcttttttatccaaaagaaaaagcccgcagaaaacaggagtgtctctgcaagcttaaaaaggccgctatgtgaaaaggtatgctgcgatacgtgtatcgccctcataagggcattgaagcgatcaacaccatcaataaattgatatggatccgatgagaagcgcgcatcctgtcatcacgatgacagcgagcaccgcccactttatcgcaaatttttgatgatcgtcgatggaaaccccgacaagcccaacaagcaaatgtgttgaaggcacaagcgggctcagcatgtgaatcggctggccgatgatggaggctcttgcaatttcgaccttattaacaccgtatgcgacagcggtttctgataaaatcgggagcactccgtaaaaataagcgtcattcggcatcagaaaagtgaaaatgccgcttgttaaggctactatcatcggaataaagccgcccatttgttcaggaatcatagacgcaagcgaaatcgccatttcatctaccatttttgtgcctgttagtattccggtaaagacccctgcggcaaatatcattgaaccgatagccaatacattgctcgaatgcgccgaaattcgctgtctctgatgatcgaggtttggataattgacaatcaatgcgatgcagaacgcgataataaacagaacggtcaagcttacttttcctgatatgagaagccctatcaatgaaagcgtcaacaataagttgaaccaccaaagcttcggacgcttccactcatcctccgcagcggcggccgtttcattggcaccagccggatgtttgagttcaatcacgccgaggcgttttcgctccgcttttccgagcatatacgcaactccgatcatacaaagcatgccgcttacgatgacaggtatcatcgggccggtcaattcagccgggtcaaccccgagcgcactcgctgcccgcggtgttgcgcctccccatggaatcgtattcataatccccatgccgactcctgcgattcccgctaatataatcgggcggatgccaagcagcaaatagagcgggagcatcgcgctcgttgtaatcatatatgttgttgatccgtctccgtccaatgcgaccagcatcgtgagcaccgcagtgccgacgacgatttttaacggatcgcctttgaccatttttaatatttttgtgaccattgggtcaaacaggccagtatcaatcataatcccgaaatataaaattgcaaacataatcataacggcggttggcgcgacttgctgaatccccgaaatcatcatgtcgccgacatcgctgaatccgaatccggcgatcagcgcaaacactatcggtgtcaagactaatgccgtcagaacagaaagccgttttgtcatgatcaataccataaacacaagcatcatgaaaaaacctaaaattgctaacacagttattcccccctcatatgaatccgcttacatttttttctctcctgttccccctaagccttgcctttttgtcatcatatgagaagaactttctgaagtaaataatttggtttttatgtatttttaattttttaaaatcattttgttctttttgaccatttttaaatacataaaaaaagtattccgcagacgcgaaatacccggttaatccccagccatgatgttttgataaaatgctgattgctcctcaaggaatcgttgcgtctccttgctgtttaaataatagctttcccattcctgttcatttattttctgcttccattccggtgaggatgtgatctttttaaacacttgatcccagtaggaaatttcttctttggtcatatttttcgggcctaatacacctctccaatgggaaaatacaaacgggatgccctgctctctccacgtcggtacatgcggatatgcgggaagccttttgtctgaagtaacagccccaagtgtgatgctgccgcttctttcatatgttttagcttctgatagagtcatcgatgcggcgtcaatttcatgtctgataagcgcctgaatgagctcttcgctgctttcatactgtaaatattgaatgttaaaagggtcaactccgtacatatcggccgccctgacgaatgacagctggtcatcattgccaagtccgggggaaaaaccgatttttaccttgccggggttctttttgatctcattcagcaaatcctttccgctctttatttccgatccttttggaagagcgatcgtctgccattcttttgcaagaatcgccagcggggtgaaatcgtctgttttcagtttgctctgtccgagaatgtaattgctcagcattaagctggatgtcatgccgatggtgtacgtatcgctgctatttatatacttccagcctttgtcaccgccgcttccgggtttatagacgatcttcacttcgctttttatcacttgtttttgtttaagtacggattgtatcgcctgagccgttaaatcccagccgcccgaaggctcagcgggtacgacgatttcaaccggccctcccgggggacgcggggcggacgattgtctttcatcccccgacattaagatcaatagacaaatcattataaacgcaaagttcttcatgtttattcatccgccaaatagtattttctctccggtctgccgataattccgtattccagctcagcgcgcgcttcttcttttgacacgagatattcggcatagcggcgggctgttgtacgtgaagcccccattttttcaccgagttcttcggctgtcattcctttagctgcgtctcgcagaacatccctgattttttgcagtgtaatcgaattgatacctgtcggcaaatcctcagcctgacgggatccgctggagaagtctccgaagatttggtcaatcattgattggctgacctgtggctgagaaagcagtgtttgcctttttttcttatattgaagcagcacctgtttgaatttttcggcagtcacaggcttaatcaaatagtgcacaattcccgcccggagcgattcctgtaaatgacatgtttcggttgctgctgtgatgatcatgatatccacttccggaaaccggtttcgaatgacaggaatcaatgttgtgcccatctcatccggcatgtaaatatccaacagcagcaagtcggcctttcggacctcgagaatttccattgtttctttggcattggccgctttaccgataatgttgaatccatcaagctgttcgatcaatctttcatgaatttgcgctacacggaaatcatcctccgcgatcacgatatcaatcaaatggattccccctctcgtgtttgcttctccttcggtataaaaacggtaaataccgctccgccgcctttttgattggccacttcaatccaaccgccaagttcacgtacagattcctttacgttggccagcccgtagcctctcttcatcccctttgaagaatatcctcgttcaaagatggctttcatcttatcaggcgctacgccgcatcctgtgtcagccacttctatgacaatatcgcggccgatgtcagtgatgaaaaatgaaacaagccgcacattttgctcagctacggcttcgaaagcgttatcaattaaattcccgatgatcgtaatgagatgagacatcccgatatgctcaggaagcggctcaagcgtgctgttttcatcaatggacaacttaacttttttctccgaagcctttcccattttgcccaacaggatagcctgcacctgctgagaatgaatgtttttgaataaaatgtcgtgctgttcattttgaatggcgtattcctctttaatcaggtcgatcgctgcttcatactcacctagctcaagcaggcctaggatcacataaagcttatttgagaattcatgtgtttgcgcgcggagatcttcagagtatttttgcacctctgtcagcgtgtcaatgagcctttttaactcggttttttgacggaaacttacgacaattccgtaagtttgaccgttttggagcatcatttttgtatttaaaataaacacttgatcgttgacgcagacctcctgattcagcaacatctgccgctgctgaaggacagacattattccggctccgggcaggatgtcatcaattggccggttgaccacaggttcgggaagcctaagcatttccgctgccgatacgttcatcattgtgacgactccttcacggttggtggcaatgatcccttctttaatcgcacgcagcatcgcatttcgttcacggtaaagagatgcaatctcttggggttcaaggccaagcgtatcttttctaatgcttttggcaagagcggcggcacccgcaaatcctatgagcaaaacgagaacagccatgaagctcaattttctcacattctctttaatacgttgttctgtctcgtttaacagaaaatcaacagacacactgccgatgaccttgctgtaaccactttgttcctggataatcggcgcacttcctctgatcaccatgcggccatcgttttttgtttcagagatgtgagagccgccgaacaagatttttctgcttcttgtcagcttcgtttgacctctcttttccgaggcgattttgatctctcccttttcgttgaggacataaatagtataggcaccggtctgttctttcatttgttcaatgacctcttgcgcctctcccttatgcccgcgcttcttttgaaagagctcttttaccggaggcatataagaaatggtttttgcagtctgaacggcaagctgttcggactgttttcttccttcttttgtttgctgaacggcaaacgtgactgtcagcaagccgattactaagataagcagtgctgcaatcaagcccataatttttgtttgcagagaaaaattgacccgttttttgaccacaggcaccagccgtcctttctaccaaaaatcataccactttttattcggaaattttggcatttttaaaaatatcctttgcaagataacgaaaaagcccaagtatatcttataagtgatgatttcataatgcaggatcaggcgtaggacagtgtgctgttagtttcttaagctgggatccggttttattccacatataggtctaaatccagaagaaagtctgcctccggccacaagacggagcttcgcatgacgattgaaggaagcagctgtcctcgcgaacaccgccccgagaatagctgctggctccttgtgttgttgtcataaattgaaaaaccattgattcacacattgagacggcccgtctgctgctgttgactactaaaacacctcaccaaacatgcgctcaataatattcaacagtacaacccccggcagtttacggcgttccacagccggtcgagctttgtaaagaacccatttaatggaaatcgagatgacgtccgttatagaggatattcatcggtcgaatcgatcatttgaataaagttaagggcagatggagatagatggtcttccgtccttacacatagcgaaatcgggttctttattacggctttatcaacatgaacctttgcgatgtctccgcgggcgatatattcgtttacttcaagagcggatacgaatgttacaccgtatccttccataaccgttctgattgtttcgtttaatccgtttatttgtacacccatatttggttttcccgcgttatgcaggttgcacagcgaaatcaatttttcccgcgaaaaacttccttcctcgcgaaagacgaaaggttcttttacaatctcctctaatgccacgtgttttgaggcgaatttatgtttttgattgactacgaataacatgtcatcttccaaaagcagcgttccttttaagaaggggccgaattccgttgtcccgccgatcaggccaatgtccgcttcgtagttgatcagctgttcacaagctttttgaaaattcgttgtcgtgatttcaacttccgttttcggaaattgctgtttaaatcggctgagccatcttggcagcaaataattggcggggaggaaggtggaggcaatacgcagttttccaattgacccttcccttaactgctccacgtacgattcaatttctttttcaagtgaaaacagccgcttggcctgttttgcaagctctgcgccggactgtgtcagcaggatccctctgcctttaggaacgaataaggtgcagtcgatctcgcgttctaatttcttaatttgcgaggtgacggcgggctggctgatacttaactgtttggcggcttgagtgacactgcctgtttcagcgaccgaatagaacaatcgcagtgcatggagattcatatttcacacctctatttataaataaaagttattaatactagataaagatatattagagttatctaaatacttttactattataaagttgaaaaacatgtattacaagaaaggagaaattgttatgagtacgcttatcttaaataaaacagcttatagcaagtctccgtatgatgtatggctgaagggactggatgaaccggtggcgatgctgacctcaaccgatcgtgcggatgaatgcaggaattatgatgtgatcgaagcatttgacgattatccggttaatggatgcatcgaaatgcgcgctttggagctgaatgaaacgtatcactttaaaacgattattgcatcctcggaatttgatatgctgagggcggggaagctgaggtcgcttttggggataaaagggcagtcttacaaaagtgctctgctgttccgcaacaaaatattaatgaaagagcaagtaagaaaagccggtgtgaaggttccagattttaagaaaatcgactcggcggccgacttatataagtttgttcaaactttcggttttcctgtggtcgttaagcctatttacggatcggggtctgttgatacaaccgttttaaggaatcggcaggacgtgtggaattttcttgcgaaaggtcttcccgatcatctggaagttgagtcgtttatcgaaggggatatgtatcatatagacggcctcatccttgatgaagaaattgtcctcagctggccgtcgcgttatatcaacgggtgtctggcgtttcaagatcatcagtttttaggcagcctccagcttgaattgaaaaatccgcttacccggcggttgactgattttgttcaaaaagcgcttgctgcccttcctgttccgaataccacaacattccatgctgaagtgtttcatacaccagatgatgaactggtgttttgtgaagtggccagtagaaccggcggcgctatggtccgtgaagcaactgcgcagactttcggttttgatatcaatgaagtgtgtgttaaagcgcaatgcggcctggaatttcatataccggaggtggacaacaatccggaccgcctaagcggctggctgttgattccgccgaaagacggcgtgctgaaagaaatcaagcctgcgccagccgcagactggatagcgaaacaaaatatatccgctcaagccggagacaggttccacggctcgtcttccagtgtagacgcaattgcaagctgtttaattatcggacgcacagaagccgaattgagaggccgtatcagccggcttgcaacgtggttccatgatcataccgtatgggaaaagaattcggatgtttgcgcaatttaaagcattcagccgccttcatccgttgatccgatttttgctgataggcacgcttgtcacgaaggcggctaagtcgatgacaaccccgtttttggcgctctatctccatatgaaaacgggagccgattttggaaccatcgggcttgtcatcggtttaggctatttttcaagcactgtaggaggggtagtcggaggagcgctttcagataaaatcggcagaaaaaaagtgatgctttcatccattttcatctggagctttgtattcattctttttggacttgttcatgatttcatgtggtttttattgctgaatattttaagcgggctttgccattcgtgttttgaacctgtgtcaaaggctttgatggctgagttatcagaacgggagatgagattccgcattttctctttgcggtatttggccatcaatgttggagctgctgtcggccctttactgggcgcttattttggtcttgccaaaaccggaacgccgtttatcatcacagggctggtctattttggctatgccatacttttgagcttgatgatgattcggctgaccacggtgaaagagacaaaaatcgctcctgaaaaagtccaggcaggttcagttttgaagacgttaaagcaagacaaggctcttcgattatacatagccggcggcatcctttttttgttcagctattcgcaaatggaaagcactttgctgcagtatttaaataacgactttgcaaacggagttaaaatattttcgactttaatcacgttaaacgcggtgacggtcatccttttacaagtgccgctcacccgtttatttgagaggtataaatccttaacaacaatatcaattggaaccgttttttgcattttggggaatatcggtttttctatcgcaaatggctggattgtttttatgctttcgatgtttgttctgacaatcggcgaaattttatgttttccttcaatgaatgtccttttggacgagctggctccggatcatatgaagggcgcgtattacggcatgcaaaacttatacaacatcggtgagtttttagggccttggctgggggggatgatgcttgccttgtacgggggaaaagccgtctttcttattgctgcgtgttcagtctttttggctttaggcgcttaccatgtgggaaggagaaagtttttatctgcacagcattatggtgtatcgcctttttcttattgaaaatttaggccgcttatgcatgaatcattaagaattacccaacctaaaaggtaaaaaaggagtatgaatcatggacacaacattgggctacctccgtgagtcactgtcgaatcaccttgaacacggcataggacaaaacatttacagaaaaatcgtttccgggcgatatgccaatgaggaagagtttgtcgagcacttggaggagcgggaaatggaatttctgaatcaagtgcttgaacatgagatgaaatatgcgctgaatgaacaggaccataaacggacaagagaattaaacgaagtgtatgaactgctgttttgaaaggcgggaatgatcaatgggtgcaatagagcggaacggatacacgtttgaaccggaatacagcgtgaccagacaaaacggtgcgatccatgtataccggcgcggccggtttgtcgaggagattccctttgagtttcacggggagtttccagagcatgatttaattgaagagcttgtcaatcattattgttatgaaaataaaatataaggcttgaagaggctgccgaccgggcggcttttatttttggatttttatatctataatccgcttgcagttttttagaacggcagcagaaaagctgccataaatatgacagctcatgcatcgctattttttcttttcgtcgtagtattgaacagggtacatggatccttccgataccattttgttatcttcgatatcatgcggagacgggtgtcctgctttttcaaccgggaatgaatctacgttgtgtttttccgaaaagtaagggatcttttctttgacgttttgcaagtacgatttcagtttttgtctgtttgtttcgtctttgagcatatatgcggtgactccggcgacaacggcgagacctgagatcagattcttttgcttcatggtcataacccctttcgattaggtgtttgcaaatgttattcccatgattgccgccggttaaaccagctgatcgagcgcttcgtctatattcgtcgtcggctgcctgcaggcgaaattttcacaaatatagacagtcgttttgttatcgactgctttgtattcggccgcaaagtcggcaatccctttgaaatcgtcaggcgattctgcggcgaggacggcataattcggctggaaggcctgctgcaaagcgcttacgatcttctgtctgtccggatcattccgttttccgagcacaacgatttccttttgcggcatgaattggctcagcaaaccttggagaaagtttgtatggccgctcggataagcagagacgtctccatggaaggcagcaaacatttttgccgcttgatcatggagcgacaagtcgccagtcagcctgcccagccgggacagctgcacggccaggacgccgtttccggacgggagggcgccgtcgtatacttctttatcccgcacgatcaaagcctcggcatcgcttcccgtaaaataaaaaccgccgtgctcttcatcccagaacagccccttcatgtctgcttcgagctttttggcttttcgcaaatcggttaaatcaagtgatgcttcatacaattcgatgtaggcccacagcaggaaggcgtagtcatcgataaatcctttatttttcacctcgccgtcacggtagcggaccatgatgcgaccgtcttgaatcaatttattctcgataaactcggctgcagctcgcgccatctccaggtattcgggcgcattgtagactttcgccgctttggcaagacccgcgatcatcagagcgttccaagaagtcagcactttatcgtcgacatgaggatacgttctttcctgacgtttttcaaaaagctttgttctcgcttcttcaagcttgttctgaagctcttcatctgtcagcgcgaattcatccttgatgtcttccagcctggtgtagatcaagtttggaatattatggccttcaaaattcccttcttgcgtgatgttgtagaccgcgcaatacaattcgccaagttcatctccaagcgtttcaaggacttcttcttttgaccacacataatatttgccctctacgccttccgtgtcggcatcaagcgctgaataaaaagcgcctttctcatcggtcatttcgcggcggacaaatgtgatgatctgctcggaaatctgtttataccgttcgtttttcgtgatttgataggcttcagtatatgcgatcagcaataaagcattatcgtaaagcattttttcaaagtggggaacaagccattcgtcatctgtcgaatagcgggcaaacccgtagccgacatggtcgtaaatgccgccgttcgccatgctgtccaacgttttcatcacgctgtacagcgcgttctcctcgccgctgtattgatgatagcgaagcagaaatgtcagcatatgggggattggaaatttcggcgcgctgccgaaaccgccgtacgccgcatcaaagctgttgatcagctgctgatacgtccgcctcaatatgtcttcgccgagcgaatcgccggcatcgcttttcgctttgattctcaggttgttggccgctttttcggcaatatcttcaacatgctcccggtttttcgcgaaggtatcggaaagctgcttcaccacctcaacaaaccccggacggttaaaacggctcgtcttcggaaaatatgtacccgcataaaacggcttctgatcaggggttaaaaacacattcagcggccagccgccctgccccgtcatcatctggcagatcgtcatataaatcgaatccacatcaggccgctcctcgcggtccactttaatggagacgaatttctcattcagaagcttcgcaacttcttcatcttcgaagctttcatgagccatgacatggcaccaatgacaagtcgaatagccgatgctgacaagtaccggcttgttttcgcgctttgctttttcgaaggcttcttcgccccacgggtaccagtcgacggggttgtgggcgtgctgaaggagatagggtgacttttcatttatgagtctgttagggacttttttcagtgacataggattacctcatcttttttgatggaaaaagtatttgattttatcttaccacagttacttttcaaaaattcccctcttatataataaaaagaatagagctcaaagggagctctattctagggtttacttttatttcttcttttttctggaaatatataagtcataatcaaaaaaataattatacaaattacaaactgaataagtctatttataactcaatagttagtaaagtcaatctcgtttgtaacttgaatggcagcaaagatagcaaataaaattagaatatatttaaatgtttctttgttcatatcaatcaacactttctttaaataattgcgtatacaacaccttgtgcaatataaccacaggtactagctaacagaagggatagcttcactcccagttttaatatcgggaatgaaatgttatgattaacaattcgcaaaatttgtcgaacgaaactgttgaataaaaccatatattgtcggggattaacatctacgcaatactgcatctgttttatcacccgattcacaatgtaaggactcccagttgagttgatcctcgcttattgatggggatttcacccattattttaaatttgtggtcacgcaggaataatccgccgcgccgatcctgtctcccattttacaccgccgatttaaacgagttcaaatattgcagaaagttggcttctttgactttattgacgatgttgccgattatggctgttttgatctttctgatggtatcccgggagcaatcaaggtggtttgcaatagcagtgtagctcatgccttccatcatgcaatcataaacgatacggtgcttttcttcttcaatgtgttccattgcgttctccaggtaatgcacaatagattcatatttgtggatccgtctctctctttggtccatctgccgtagttctgcctgactgacgcctgctgataccctcggcatgcctgcttcatccccgtatgttgcagtgagttttgtgctagtaaagtctactttgttcaacaaacggttgagccttttgatctcccgcagcatgaatttataatcacgaatccattcctcaatctcccaagcaatcatttgatctgtcatagtgctttccctcctgataattaaatagagtaggtgtcattccagttgtttgctttttgctctgcgatatattgaggcctcaatacctctttcacgctgatactgaaggttttgaataagaaggctttcaactcgttatagagctcttctctgccgcaaaagatatttacaagctttccgtttttataagcgaatccgtatttcatcctgaaactccccttactttctgcgtttataagcgccgcctttgccacgtctgagtgtttgcatgtttgtgttcatcattgattgccagaaacgatctgagcgctcctgttgcttctgtgattgtttcttttttgcttgtttaatgtctaattactcctttcatagctagtaatcgcgatagacatatggttagttgcaaaaaaaaacggacaccgatcgaagcacaaatttctctgtacaacgatcagtgtccgcaggctttccgtcttggacttattcaattttaaaatttatttttacggccctgtgccacaacttacttcgtattcaccatctgatgattttttcgaatagcataagtgaggagtttgccctgtttcatctttccaatctagccaatttacataataaagattcccagattcattgtctccttctcttttctggagaactgcaaagtagctttggtagggatatcctcttttataaatttcgtgtctgattgctcctttttccgaagaatctgtaaagacaacaggagatagaaccggaagtgctatcaatataactataagtgctgctaagagagaaagtataactttagttttctttttcattttttcctccgatacctttttatgtatttgtttttatgatatattattacatgtattttatgccatatttcaattggtgtaaatgataaatattacttatatttagattttattggaggtttcgtatgaaaaaagaattgctcgcttcactagttttatgtctatcgttgtcaccattagtgtcaacaaatgaagtttttgcagccactactaataaagaggctaaagaaaaagtttcaattaccaccgagattggttacgaaaaagttaaggatatgttggaacaacaaaaatatgactttgaacacaacactcctttagctcatcctaaagagtctaaattgactgattccgacgaaggagtcttactgtattctgcgttaagtaaagtggacaaacaaaaattccacgagtttacatacgatatagacgatgttaagacttctgaaaaaaacaataagctaattgttgaagcttatattactcgaaactttgtttttggtgttgaaaaagtaacaacatctctgggtgataatattaaacttgaaattcccaaaacagcttctgagaaaccaagttctcaatcaacaaatacttctaatttaagtttatctgaagttaaaaattcttctaatcaattaaatgtaataccattgaataattcttctaatcaactaaatgtaacacaattaaataattcttcttcaactctacaatatgaaaatgatgaaggatattctacggatgttaaattagatgaatttttaaagaaatataagcaagaagtgaaaaaggatgataaagaagaagtaaaaagtgaaaataaaccagtaagtatgaatttcaatgctgttaactctaatcaactaaccgtgatgccattatctgtaaaaggatatagtggttacgctgcaatgaaatatgcagaaaaatatgccttgaaaccaaataaaaactataaatattataaagacaaagattgtactaactttgtttcccaagcattaagagctggaagaatgccgtactttaaagaatggaaaccctatacaggtgcttgggttaatgcaggagcctttagatcatacattttaaaagccggcggaataaaaatgaagactgtttctgatacatattcaaatgtaaagcttggagatgtatatcactatgattaccataataaaataggtcttcgctatgctgatggttggatggatcatacggctatcgtaacgagccgagcaaatatgaaactttatgtaagttatcattctaccaatagacttaacgttcctcgggaatatgttacttctaaggaaggcggaaaacggtatgtttctagtattcgcaattaaataacttgataaaaagcccagaatgagtttagtaaaagttatggttgattccatatcaatccattacctattaaactgctgggaaagcaagcccctgatccagaatggttcaggggctttttatgagtacgtgtttcaatgcttagaaaatccgttcaattgtcttccttcttctctatatacttatcaatatctttaaagtaagccgcacccgtgaatgaaatgattgccccgatcaaagcaaggttcgctttcatgtccgaccggtaatcgtgttggaaatatatccaggcaaagagtgacaagtcaaaaatatataagaaagttttaaggagattagaattttctaatctccttaagcatcgaccattttttttgcaattagcttaaaatctttttcatttatctcaaaatgtccaaattgaaaagaatatccccaacgctgctcgtctttaatgaaagaaagctatgggattaatgcgaatcagtgtttctgtgcaatgaataaaacttatttttctccggaaaggtttgaagtcatttcccatttcaaactaaaaaaaaaatcgaaacctatagacaagaaaataaattagcagacgaatcgaagtctgccggtgcttcggacgatcaaaaggggattacaattggtgccgctgttatggtgcttacccaaattgtgatggttgcgattatgaccatgacgcccgttcatatgcagcaccacggacacagcttgggagatgtcgggatcgtgataggttttcatatcggttcaatgtatcttccgtcacttgtcacagggattcttgttgataaaattggccggacagccataagcatcgcctcaggggtgaccctgctgctcgctggtgcagtggcggcgctggctcccagcgattcgctcgttttattgatcgttgccctttcgctgcttggattgggatggaactttggattaatcagcggaactgcacaaattatcgattcgaccgagccttcaacacgtgcgaaagtgcagggaacgcttgatgttttgatcgcattggcgggggcttccggcggggctctttccggaatggttgtcgctcattcaagctatgccgtgttatccttggcgggcgggctgttatccttggctctgattccagccgtcatttggccgcgaagaaaaacaaatactcaaaaagggtaggaaaaggtctatcggattcggggcctatcggacatcgccgccgggctttcttaatttaaaaacgatgaaatcggggcacctgagatcttcttcaaatgaagggtattttttcagcatctcttttgacggtctcggttcctcgaccgcttctaattgaaagccggctttgatgatcgtattgatatagcttgtcagtgttctgtgaaaaagaaacattttctcctcgccgcccagcggctgctcatatgcgccttcgtaaaaataccgatcaacgttccaatggagcttttggccgtctttggttctttcccatccgctttccggggtgacgaaacaagggtgtaatattgaaaaaataaagcatcctccatcttttaataacctgtgcatttcctgaaacgctttttcatcatttgcgaggtcttggatgaccatattcgatatgatgatatcaaagctttgctcatctaaaaaatgcaagtcctcacaattgccgtgccgataatgaatgtgcaatccgtccggcgttctttccttggcgatctcaagcattcttgtcgaatagtcaaccgccgttacaactgcttcgcgggcggccagcattctgcttaaatatccttctccgcacccggcatccagcactttttgatttttcaccgtttcaatgagagaaaagatgacggggttcaaaaagacttctttatgtatatcgccttgttcagtatggtttgcagcatagctatctgcaaaccggttccatctttgaatggcttcttcagtggcagcgttttttctcatatcacttcctccttttgacatgatcataccacaaaccatattacgttttagccaggttaaaggacattcctgttgacaaagcagcctatttgtaattatgatagttacatcaagtgtaacgaaatttgttacagatcaagattaaaacattcaggaggaattcgaatatgaaaatgctagtaacgggggcaaccggaaaattaggatcgaaaattgtggaaaagctgctggaaactgtaccggcggatcagctggcggtcagcgtgcgcaatccggaaaaagcggaagcgctgcgggcgcgcggggtcgatgtgcgccacggggattttgaccgcccggaaacattggaatccgcatttcgaggcattgaccgtctgctgattatctctgccgatggagacaatgagacgagaatccgtcagcacggcaatgcggtagctgccgcagagcgcgccggagttcggtttatcgcttatacgagcattgcgaatgcccgcgaaagcaaaaacttccttgcgccgactcacaaagcaactgaagaagcgattttgcaaacggggattccatactccttcttgcgcaataactggtacttggaaaatgaaatgtcgagtattcaaggcgttttggcgggagccccttgggtgacatcagcagagaatggcaaagtgggctgggcgctgcagcaggattacgcggatgcagcggcagcggttctgtccggcgaaggccacgaaaacaccgtttacgaactttcaggcaaactattaactcaggaagaaatcgcttcagcccttggggaagtattgggcaaagaagttcccgttcagcatgttgacgatgctgcctatcgcgatatcatgaaaaatgcgggtgtgccggattttctgattccgatggttgtcgatatccaaaaaggcattcgtgaaggcacacttgaagtcgaaagcgatgattttgaaaaagtgctcggccgtccgctcacgccaattaaagaaggattggctcaaatcgttgcaagaatctcagaagcgaaataatgatcaataggattcgaaagagtgatgaacagaattacagtgttcatcactctttttttaaaagatagatcaaaaaagactcgccacaatcaccgcacatactttatagcctaagttacttttattaaaataagtaaaatatcgactgaattccagagctaatgatgaaggaataaaaagacaggcatgtgcggctgcttgagaagaaaaactgaaagctgatggcagcgcatgaatttgcagtgtgtattaacttgtaaagagcctcgatagtagcctctgtttggattgcggctcatccatcatcccccgcgacagtttcactattaaaactcacaaatatgcacctgaccgttatttgattttcctttgctgtattaaacctatggccacaagcatgacagtgccgagtaaggcaatcggaagaaaccacccgccaaatccgcttccccagtctaaagcgattgacacggattcaattaatatgagagaaaaaatgattaagcatgcattttttaagcggttgatcaactttcggctgagcaggtagaagtgttcagcgtttgtttcattcaggcgctttggatgattgtgaatctcagggtgcttttctaggaactgcatgaacagaaggataattaatccgattcccggcaatatgaaaagctcccattttgacccccagcgatccacttcaccgagtgcgttgtaatgtgcaggcaccttttcggggagcgatccccagacagcggccaatagaatgatcgatcccaggtaaaagaaatagccaaatgcgttccaaacccgttccccttttgtcttttgaatgttgatcttagaaccgtcggctctgttctgcatatgtacccctccttagttttaaatacggtttgacctatgaaaaagttcgggattttcgccagctggaatggggtatatttgcggtgagtccaggcaatgttaagggaatgtaaatcatcagccggcaatgttaagttattgtaaattttcgatttgaatcgtttacataggctttaatctccatcataatcatagtgtttggtttgtagatttatgtcgaattaggggggcacgactttggaaatagatgtgcagaaattgctttttgaattcattggaggtctcgggatctttcttctcggtattaagtttatgggagaaggacttcaaaaatcagccggagataagctgagagacatattagatcgttttacaagcaaccctctgatgggtgttttggcaggtatgattgtcacggttttaattcaaagcagttccggcacgaccgttatcactgtcggtcttgtcagcgccggctttatgaccctccgccaggcgatcggcgtcattatgggtgcgaacatcggaacgacggccacagcctttattatcggctttgacgttggggcatatgcgcttccgatcatcgccattggttcatttttgctgtttttcttaaagagcaaaaaatttcagaacatcggacaaattctgtttggatttggtgcgcttttctacggcttggaattaatgagcagcgggatgaagccgctccggacggttgaagcttttcatgatttaacagtcagcatgagtgcgaatcctattctcggcgtgctcgtcggcacccttttcaccgttctcgtccaaagctcaagtgcaacgatcgggatcctgcaagggctgtttgccgattcattaatagatctaaacggcgctctgcctgtattattcggagacaatatcggtacgacgattaccgctgtactggcatctcttggcgcctcagtggcagccaaacgggccgcggccgttcacgtattgttcaacctgattggaacagcgattttcctgatcttgctgaagccgttcacagctttgattttaatgcttcaatcctctttagggctggaccctaagatggtgattgcgtttgcccacgggatctttaatacgtcgaatacgctgattcagcttccgtttgtcggcatattggctttgatcgttacgaagctgattccaggcaaagattcggttgtggactataaagcaacacatcttgatccgctgttcattcagcagtctccttcaattgcgctgggacaggcgaaagaagaagtattgcgcatgggtgaatttgcggtaaagggacttgaggaaacaaaagagttttttaatacaaaacaggcaaaacatgcgcaaagcgcttttcaaatagaagatgcgatcaacaatttggacaggaagataaccgattacttgatcgaattgtccgccactacgctttctgaacaagaatctgaagaacatcatatgttaatggatactgtcagagacattgaaagaatcggcgatcactttgaaaacttggttgagcttggtgagtaccagcaatccaacagggtgaaaatttccgaagcggcaatggctgatttaacggaaatgcttgacctgaccatttccactgttaaggagtccatcaccgctcttggggaaaataacgaagatgccgcaagacgcgtagtcgaaaaagaaaatcagattgataaaatggaacgcaagcttcgcaaaaagcacattcttcgcttaaacgacggattatgcagcggacaagccggcgtgatcttcgtcgatatcaccagcaacctggaaaggatcggcgaccatgccgtcaatattgctgaagctgttttaggcgaagaaaagcattaaaaaaccgggagtcattcccggttttttattttgtgggccttttttatcaaggtgttacatatttactaaattgtgagcaaaaaggaagaacattcttcttctggagacgtaaatcaagtataatggttttattctttaggaggtattaagatgcataaatacagaagaagaaacacaacggcctttacggttatgtcatatttcacatttttcgcgggagtctttttatttggtatcgggctatacaatgcggacaatctgcagctcaatgaaaaaggctattacatagccgtgatgattttagtggcggtcggcgcgattttgacccagaaagtgacgagagacaatgccgaggacaatgaaatcattgcggagcaggagagaagacagaatttgtctagcggcgagtaagcataaaaaaagcatctttagggatgcttttttttaatttgaaatacttttatatttattttccaaaacgaaatcaatcattccaataatttttgtatggttcgttttttttctaaagtgtaaaaagttttgttctttgtttctttgagatttagtgatcgtgccgaacacccagatggagctcatgataagtaatatcgataacaaagccggaaaataaccttttgaaacgtcgggtaaaatggaattggcttgacccgaacatacagtagttacaatggaggcgaatatggaactggcgagcgaagctttgatcacgtggctgttttagcgtaggacctgaaaaataaactttcagccggtttaacgtggataaatcttgtttttcgaggtatgccatcagctcttcatcgttttcagctttcgataacaatagagtttcagcggtttgttttgtttcttcgaatagttgtttgtctgtttgcatgtcttggtctccttcttatttagtttgaatgatagagaatcaaagcagaggggaatgttcctctgctttctaattgaattcctttttaaagcgttcatctaaaatgaaatcaatcatacccgtgattctggaatattccgctcttttttggaagtgcaggattgtttgcatcggtccttttcgcgaggagatcagcatcttgacgatccaaagaaaagagaagatcagatagaacatgaagaagaatgaaaatagccttgaaagaccatggttgagggaggagatctgaccagataaaaaggccgccataatgacagcagtcatactgctaaaaaaaatccctttaatcaaatacgttaatgtaaaacttggatttgaaaaatagatttttagctgatttaatgtaacagattcttgatttgcaaggtatgtaagcagctcttcgtcacttttgtgagactcaagaagtttggctgtatgttcagctttttgaaataattgtttttcgtttctcattggattgtcactcctattcataaaaaacatgagattttattggttcggtatattttttaatgcctttttgtatttttgttgtaaaacataatcaatcatttttacgatacgtgcaaactcggctttcttggaaaagtgtgtaatgaattgaatcggcttttttttcaggatgacaagctgtttaagcacccagaataaacaccccgtaaatatgacagctaatattataatggagatgccggaaatgaaagggaatatcgaatctgcttgaccagaaagaattgcagttatgaacgaagccaatattatactgaaaaatgctgcactgatgaaataatgaagcgcaaatgaaggatctgagtaatagactttcagctgatttaaggtcagtgaatcttgtttagcgagaaaggctaatagctcttcgtcgctcttatcgcggtaagttttaagggttttggctgttttctgcgtttcaatgaatacttgtttgtctgtgttcaatgttaatgcctccacgatacttgatatatattaaagattagaaaaactgcataaatatattatattatgtatttatgcagttttcattaaataaggaaattaatgagatattagttcgccaaatattgcaaataacacagcagacaacgccgtgccaatagcgatttcagcacgctattacaacagctgcatccccgattgttcttcttttctttcattatgctttcactaatagatctcaaacatatgacataaaaaaatacggaaattgactccttcactaaatgaagcgaagtcaatttccgtatcttgtttatctcaacagccccaagcttcctgtcagccgcgcaacttttttcttatccccgcaaatgccgattccaaaatagcggtaatcggaagctgcggtgctttgaaatgcctcaatatatgcttcatatgtatgaatgctttgcgctacatcggtaaaatcaaccgtcagaatatcgttgaattcgtcggtcagcagcttttgacttaattgatgaagcagctcggcattgccttttaaaatggggattgggattttgacgatacctaaatggtcgattcccgagccgtctgttacagtttctccaatcagatcgggtttgtttttgccgagggccgcccccaggatggcagctgtattggcgattagcccgagcggcaggctttcatcgatgatcagtgcgcattttgtctcttccctcaaatttgttcctccttcagctgcggttttggttttgtttcagaaatataaaggccggccaatgtgagcgctcctccgcaaaaagcaacccatgtcagtttttcttgcagaatgataacggatgccgcaatagtgatgacgggcaccatatagatataagcgctcgtttttaccgctccaagcacaccgaccgaccagttccatgtcacaaagcaaagcgcagatgcgcccgcgcctaagaataggatgttcaaccaattgacgggggaggaaaaagggcttgcgtcgaagcggaaatcaaacaggaacagagcgggaaccatgaatagcaaaccgtacagaaagatccgctgtgtgcattggattgtatggtaaccgaatgtgctgatttttttcatcaaaatcgcatatgccgcccagacgaatgcggaggcagcagcgagaatgtcgccgagcggattcaatttaagcatcatttgtccattaaagaaaatgagcgcaagtccagtgaaagcggcggcgaacccaatgaaaaagcggggctccagcttttcgcccgaaaggagaaaatgcgccaataccgcggtgatcatcggaataaccgcgacgatcatgccggcgtttgaggcgtaggtaagagtaagcgcgatgttttccaacagaaagtaaagcctcactccgcataaacctgctcccgcaaacagcgcttcttgcctccagctccggaaagtcagcacatgcggatgcaccatgatcagcacaatcaacccgatgagaaaacggtaaaacaatatatctacgggcgggaaatcctcgagcagcacctttgttgagacaaaagtagtaccccagatgatgatcgtgatcacagctgcgaggtgtccggcggtttcgcgtcttgtcttcatcctttgatctcctgcctgtcatattcaaaaattttcatatattgtttcggcgtcagcccgacctgccgcttgaaaaatttcgtcatatggctctgatcactgaagcctgtttggaaagccgcatcgattggttttacgccttcttccaacagcttcttcgcatgattgatacgaacggtttccaagtagctgtagggggaaattcctttctgcttcgtaaacgaccgcaggaggtgatacttgctccagcctgtcagcctgcttaaatgttcaagcgtaatgttttcctggtaatgggattccaaataactgcacaccgctttgacttcgtcggacggttcaggtgcattttcaagaaacgtgacatcagaatacgtacgaatcagctcttcgagaaggttgagaaaaagctcctcttttttcaaggctttttctttttgcaatatttgaatgtgtagctccttcaagctggcgttcagctcatggcggaacaagacattctccgtgaaatatgggaggctgtcggccccagtgatctccttcacaaatcctctcataacatcaggcatcacgttaatgcagcggtaatcgagcgcctttccgtcaatctgctcgcaactgtgcgtgtcataaggattgaaaagcacgagatcgccttgattaatgatgtattcttctcccttgcaaagcaaatagcgctgccccttctcaataaaaccaatcacaaaatactcgtggaagtgattcggaaacttctggataatgcctttaaagcggtaggcttcaacatttagatcagggtcgaggaaaagcgtgcgggtttcatttcgcatggcgggcctccttggtgtgatgatgtttaagtttatcatgtttatgggagatttcttgtatgatgttgcttaatgaaaaaaaggatacaatggaagaaaaaaagaggtactgaaagtgaaaaagaaatggattgcatcaattgccttcacgatgatgctgggcatcggaatcacgatttactgtctgttttttgaacatagcaaactgagcgaactgacttcagacggggaatgggagctctcgtattctaaagaaaggggagatcaatattggaatggctatgtttcgaagaaaacgagtgaagatgcggagttaaagagagtcgtgttttttgtgaatggaagagagacggttgattacgaaaaggatgagcaagaggaaggcggaacacattctgatatagtcaatgttgtctggttaggtgatgccccagaaaaaagtgagcaatttgaagctgtcgtggaaaggaaccagaatggtggatatcataaggagaggattaaactgacagaaaaaaacgggttataaagattgaaccattgtaacttttggtgtaaaattacactaaaagttacaatggaggttctccatggataaagaatacataaccgaactgatctcatccaaattaagattaatccgggcggaaagcggctatacgcaggagaaaatggcgaacgtgctcgggatgtcgaagaaaacgctcgtgcaaatcgaaaagggcaggtcggctgcgggctgggcgcatgttgtcgcggtatgcgcgctttttcggaacagtgaagtgctgcaggccgtcctcggggatgagccccttgaggtggtggagactgttgctcaccgaagcatcgacagaccaaaagggaagacgcttggcggaaaggtgtggtggcgggacattgagaaaaaaggagagtttcgccttcagcaaaacttgatttctcaccattaccgcatcttggattcgtatgacgacctatggttcagcacgtttgaaaagcaggatgcagttgcgcgtttggacgagctgttaaatgagcaggacggggtggaatgatgaaaaagatagcagaggcatcaaaatcctctgaattggctggtcttgatccccgcaagacaagacacggggaataacactgcgtgtctcatctggggaatcggacgtgagaacagttttcgcccgccttattctcactccagcacatcatcaagcagcttccacatcagctccctccggtttcctgcgcccgtcttcaaaaaaaacgatttcaagtggtcttgaacagtgtaagccgatatatgcaattcgtctccgatggcttttgttgatagtccgcggatgacccggtaagcgatgtctttttcccggtcggacaggctgtaggcttccgctatcagcggaatggtttctgcgggtgaagcaggctcaaatgaaacggcgatctggcctgacggtccaaatccgtctaaacggctcgctttaatggataggcaggaatggcctggaatcgagatgaccgtttttgccggagctgtagtttcagccgctgcgcgcgtgcagacggctcggacgggtctcggcacggcttcgctgccgatgctttcccagccgcgcaagatgttcagccaatggagggccgctcgattgcatgacaagagctgcaggtcttccgacaaaatcagaatgcctccgacatgtttcatgtgaaacacgtctttttttggcagatggtgtctgaattgctgaagatgccggccgataagcggtgcaagagaagcgagcaggctctgatccttttctgtaaacaccggctgtccacttttcctcaggcagtgtgaggtgtatcccaagcactgccccttgctgagcggtttgtgatatcgtttgacatcttgttagaaagtgagatgataaatattagaaaagaatagaaggagtggggaaatatgcagcctgaagatattgtcagaagcggtccaaaccaatacgtttgcagagaggggatcgtgaaagaactgccgtcatttgcgaatgcattcgaacgtcctgtcatcatttcaggggttaaatcgtttaaagcttttacacgttatacgacgcctccagccgattggaaagtcgttcagcatacgggctgcagttccctaaataagattaaaaaagcagcagaggaagcagaatcagcagacgtcatcataggaataggcgggggaaccgtcttagatacagcgaaggcagccgccgatttgctgaacattgaagtcatgacgattccgacgatcccgggaacatgtgcggcaagcacgccgttaagcgtcatctatgacgatgaaggtaacttttcgggcgtccaatatcagaagcgctccagctatttgacactggtcgatccgctgctgcttctctcttcaccggtcgcttatgtgaaaagcggaatcggcgatacgcttgcgaaatggtatgaggcagaagcgatcatcagaaatacggccgattcgctttctatcatggttcagacagggctgaggcagtctgtctatattcgggatattttgttgacagaaagcctgaaagccatagagagccttgaaaaaggcgaatcctccccagctttcacaaatgtcctcgaagcggtcattgcgctggcaggcacagtaggcggatatgcgggccgctacggcagaatggccggggcccatgccattcacaacggcttgacgttcatccccgaaacccatcgtgtgctgcacggccaaaaggtagcctacgggatactggtgcagcttgctttagaagggcggacagatgaaatagccgaactgattcccttttatgaagggctcggttttccgagaagacttagcgatttgggcattttagaaaatattgaagcggccaaacggatcatcgccgcccatgccgcgcgtccggatgaatctttatgtttgatgggatcttttcatgaagcggatgtgattgcggcgatagagtcgcttgaataaacccggttttatacgcctttgaactattcaaaggcgtattttatttttagcgacttcttgagaaaaaaaccactcttgtaaacaaggtctttatcactatatttttgtaaaaaagtatcagctgccgccgatataaataaaaactactttgtttggaagaagggggagcaatgtgaaaagcccaagatggaacaatatcacaatcggcggcaaatacggcattattttctttgtgatgttaacagcgtttttaacatccgttttgattacatatggtctgttaaaagatacgagccagacggttcaggatacgaaatcgaaaaatgaaacggccgttcagtcggcaaagctgatgtccctatatcaaaataaatatttgcacattccggagtacatcataaacgcccaggatgaaaagctgaccgattatatgaagtacagccaggaatttgccgatacggccaaaaagctgaaaaaagagcttcattcggatgagcagcttgacatgttcgatcaaatcattgaaaacaatcattcactggatgagtactttttcagcgaaattgttcccaacgtgcagcaaatcaacaccgagaaatttttaacccttcagaaaaaagcgaacaagctcaaagaggagacgatgacgttaggcgaaagcttgaaagaaaacgctgtcaaaaccaatgttgagtcaattggacaagcccaatccaatatgacgaaaaccatttatattttaggcgtctcaattctgatttcggcgattgtgtcggcgggactcctgatcattgtcagccggcagatcaagaaaagtctgaagcgtgttgtggcagcaagcgaagaaattgcaaagggtcatttgaactttgaagcccttgattacaaaggaaaagatgaaatcggccagctttcgcaagcggtgaatcatatgggcggaagcctgcgtgagatgatcgtcgaagtatcagggatcgcagccgaagtcgacaagcaatgtcttacgtttacgagcgtctcggctgatgtcagagaaggaagcgaacagatcgctgtcaccgttgaagaattggcaaacggggccacgaatcaggcaaatgaagcagctaatatttccgagcagacacaggagctcaccgggcaaattcagcacgctcatgaaagcggcgaaacgctggcccggttttcaaaagaagtgcttcacgtgtctgtcgacggcgacaaacagatggctcaatcattggagcaaatgaatgtcatcaatcatgtaatggaagcatccgtagaaaaagtcagtgtgctggaggaacagacacagtcaatccacaagcttgtcgaaatgataacaggtatggccgaacaaacgaatttgctcgcattaaacgcgtccatagaagcggcaagggccggcgacgccggaaaagggtttgccgttgtagccggcgaggtgaaaagactggctgaagaagtgaaaagctctgtcggcagcatcaccgaaatcgtcacggcgattcaaaccgaaacatcttccatggccggtgatttaaaaaccggtttttcagaagttcataaaggaaaaaaccagattgagacttccggccgatacttttcagagattaaaaataaagtgacggatatggctggccgtgtatcggacatttcggaggcattatcgcatttcagacgttcaagcgaggagattaacggctcggtcgagcatatcgcggcgatttccgaagaaagcgcggccggttctgaagaaatttcagcgtccgtacatgagcaaagcggctcgattgaaaagatggacgaaagcgcaaggcttctgggagagatggttgaacggatgaatgtgatgatcaaacggtttaagctctgatgccgatacagaatggggggttttaatgttgtcgatatatgtgaaaagagggctgttggcacttgcgctgttcagtctcctcacagctgttgccgggtgctcattcaattctgctgaaaaaagcgccaaccgtgaagaaaaagtaaagctgattgccgactccgacaaattgtacgtcggttttgccatcgatacgctgaaggaagaacgctggtacaaagataaagaagcgttcgagaaagaagttaaaaacctcgggggggaagtcaagacgcttgccgctaacggaaataaagaagttcagattcagcaggccgagctcttgatcagcgaaggcgtcgacgtgcttgttgttgtaccggcagatgcggatgccgcggcggagatcgtgaaaaaggcgcacagcgccggtgtaaaagtgatttcgtatgaccggctgattcgaaacgcggatgttgattattacgtttcatttgataacgaaaaggtcggggaactgcaggcggaagcgattgtaaaaaaagcgaagaaaggaaacttcgtatatatcggcggatcgtctcttgacaacaatgcggtcttattccggaacggcgccatgaaagtgctcgaaccgttgaagcggcagggcaaagtcaagctcgtgcttgacgaatatacgaaagactggctgccagaagaagcgaaaaagaacatgaaaaaagcattgaacaagacgagagatatcgacgccgtgatcgccgccaatgacggtacggctggcggggtgatcgaggcgcttcaggaggcgggcctggccgggaaaattccggtgtccggacaggacgcggaaattcaaggcgtccgacgaattgtgaacggtacgcagacgatgaccgtttacaaaccgattcccgcgcttgccaaaaaaagcgctgaaatggctgttcaagcggcgaaaggcgaagcgattcaaaccgatacaaccgtcgaaaacggcaaagccaaagtaccggcgattttacttgagccgtatgccgttacgaaaggcaatatcaatgagactgtgatcaaagacggccatctgtccaaaaaagatattaataaataaaacgaagtcagccatccgctacaggatggctgactttgttaaatttccactttcacatcggcgcttttcttaagcttttcgacctgctgtccgagtttttcctgtcttttttgctgtttgagcatatcttggatttgctgtttgacatcgtcaaacgcaggtgtgtttttctgtccgctgtctttttgctgtgcggcaaattgatcataatagtctttgatttctttgtctgtaacctgatctgtcggcagttctttgtcaatatatttctctgttttgatgctgtcggcaatgtcgcttttcagcgtgttcatgtttaagcctgcttttttgaccgcttcctcaaaatcttgctcgtttttatactgctttttgctttcgtccagctgtttttcaatttctttctcagatgctttgtagccttttttgtccgcttcctgcgtaattaaagcctgtccgatcaggctgtcgatcgcctgctttttgatttgctgcgccgcatctttagaagtcgggtcctgtcctgtttgctgatattgcatttgagcggttgataatacgctgttatagtccttgcctgtgatcttttcatcgtttacgacagccactgtttttgtgtcatcaaccttttgctgatcaagctttttctgcattgcttttatttgcttttcctgatcctgctgcccgctttgtgcggttttcgcttgatcgttggcctgggattgctgatcatcatgatttgaagagcaggcgcccaacacgacagccaataatccgatcatgagagatgatatgctttttttcatgatatatctcctttcttcaaacagaagtgaatcttaaaatgacctttagtgggcattctaaacgatcgtctctgaaaaagaaaccatttggaatcaattttccaaaatgtaatcgaattgaaaggagatcgtaatgtgatgaccgagttccggtttacttgatatgcttcgaatcaaagccgtacacttcaaagtccttcgcaaaaatgtcgtgcaccaattcttttgtttcgtcattgtaaaagctctcaaaagtcggaaacgcccagtcgaaggttgacatagtcaaaacggtgtcagcaaacttcccttttttaatcataatgtctgacagatggtgcggtgattgtgacagctgtgataacggagatttcaataatttgtatttgttttcaatctctctgatttgtgcgctgaattgctcgaggtaaatataattggtgacaaactcttcttctccttcgatatactggggaccaaggtgtcggtcaatggcattgatatccgtcccgagatcttttagatgatgcaaaaattgcgtgaaagaaagccctgtgtttatatcactgttgaacagacaaataaaattcggggagcaaatcgctgccagaaaggaactgactgctctccgaaaagggttgcgtacaaccttgtaagtgtcctttttaccctctcttaaatccgtcagaagatccttcacataattcggcttctgcgtatagatcgaatttctgtagtggtgaacttctccggcgcatcttcgattgacatcttcaagcagaccgttttggaaaaagaaccagcgattcagcgtcgtgcagccgctttttggaatccagaacagaatgatcggaaaatcctcagcataaagaggggtataaaggtaaatcaagcgattcagtctctcatcttcaaacatacagaacacatccacttcttacttggttttgggcgcgcttgagacagcggctgcctttatacacaaaatatgccgccggcaatgaattgatagggcgataatataaaaatattttaaaatgataagaccggcaattaaatccttattgaaccacatatagaaaattaagttatattttaaaaccattttatgatactagagtgagcctgtacaattcatattgatggaattttttgtttcactgcatgctccccctgaggtaacataaaaatgagagatgcctggggcaaaatagcttgcaggaaaaaggaagggagggtatccatgcagattcgcatgactgaatatcaggttcccgaccccgaatcggggccgtacgggatcacagtatgtgcaaacgggcgcatttggtttactgaacaaaaggggaaccggattggtatgctcacagagtccggggatatcaccgaatatacgattccgacggagagcgcaggcgcctcgattattacgtccgggattgacggcgagctttggtttacagagtataaagcggggaaaatcggcaaaatcacgcctcaagggaaaataaccgagtatgctcttccaccgggtgctgccccgtttggaatcgctgcaggctgtgacgacgccatgtggtatacagatatggccggacatcaaatcggcaggctgtcctcttcaggcgaaataacagaatacaaactgcccaaaccaggagccttcccgtcatttattacaaggggagcagacggcgcgctctggtttacacaaaaccaaagcggctccatcgggcgaataacggcagatggagacatcagcgagtatccgctgccccaagaacaatccggcccggtcgggatcactgccggcccggacggggctttatggtttacagaaataaacgcaaatcaaattgggagaataacggtctcaggaaagatcagcgaataccagcttccgacagcgcatgcacgcccgcacgcgattgccgcaggcggtgacggagcactgtggtttacggaatggggcgcgggtcaaatcggccgcattacagtcgacggggatattacggaatatccaatcccgacggcagattctgaaccgcacgggatagcggccggatcagcccattcgaactggtttgcagaagagtgcggccgtattgggaaaatctctatccaaaattaagaaacgtccagccaactggacgttctttttttattgttattccgttctcgtttccattctgcggttgggcgagccaaggcctttattcatcaagtaaaaatggaaaatgtattcaccgatcgccatagcgacagctgcaaaaaacgcggccaatgcagcggtgttggcagccgttcccatcgcaagagccatcagccaaacgacaagaaaagcgacgcctaaatcggctaaagtggccgtgatgttgttggttttcggcagaataaacaaatcacccagcaaataggatactgcgccaagaacaatcgtgatgaatagggtgttttcaaaactaaaactaaacccgagccctagaacaaggtacagaatcacaatcgtcatgatgcctttgatggcaagggctttcacatgttccataaccattcgctcctttatacgggattttagtttttcttttcctcgtattcagaaaatgaaacatgcaaacttgcattcttaacgggctcagacggattccagctattttttcggtttgttgcataatagatggtatagcataacgccataaacggcacaccgcaaaaaagggcgatcctttggttcggatcaaaggcaatgccaatgcaggatgccaggcatagcagaaaagcggcaatcggtacggccggataaagcggtgtccggtattttaagtcgtctgcggtgtttccctcagccaaaaagcgtctgcggaacatgaactgcgaagccgcaatgctcatccagacagcaacaacggcaaaccctgaaatcgacacaagaacgatgtagacggaatcaggcgcaaacacgctggagagcagcgacagaatgccgccgagcatgctgaagatcagcgcgttcaacgggattccccgtgaagtcagcttttgaaatacggggtgcaaagttttttcttttgacagtgaccagagcatccgggagcatgcatacaagcctgagttggccgcggaaagcagagccgtcagaattacaaagttcatgatgtcggccgcatatggaacaccgatgcggtcaaagacgacgacaaatgggcttttgatcacaccggcttctttaaccggaatgaggcacgaaagcacgaaaatcgttccgatgaagaaaagcaccagtctccagagtgttgtcttgatcgcttttggaatgttcttttccggttcggcgctttctccggcggcaattccgatcagctccgtacccgaaaacgcaaaattcacggagagcatcgccataaaaattggaaggaagccgtttggaaagagaccgccttctcctgcaaagtttgaaagaagcggtgcagcgtctgcattttgtatcgggatgatgccgaatatcgccgctcctcctaatataataaacaatataatggcaagcactttaatgcttgaaaaccaaaattcggattcggcgaaaaatctcactgagacagcattgagcgcgaaaatcagtgcagcgaataccgcgctccacatccagactgaagtatcggggaaccagcgctgcattaataacccggcagcggtaaattccgaaccgagcgcgacagcccaggtcagccagtatagccaggcgacggtgaatccggtgcccggcccgatgaatctggaggcgtacatatgaaacgatccggtgacaggcatggcgaccgataattcgccgaggcagagcatgacaaggtagacgatcagagccccggccaagtaggctagaatcgttccggcaggaccagcctgtgagatcgtataaccggaacttaagaaaaggcccgtgccgataacgcctcctaaggaaagcatgataaggtgtctcgtttgcatttttctttgaaagttctggcgattggtgtttgactgttccattatacctccagctttctcgcccaggcggcgacggctttgatgtcctcaggcgttgttctgcagcagccgccgatcagctgtgccccttggttataccagctgcgggcgctttctccgaaagaagttttacatgccgcgccatgccatgttttcgtttccgggtcatactgttcaccggaatttggatagacgataatcggtttagctgtatgctttttgatgccgccgatgagcgaagagacatgctccagccgcgtacagtttactcctactgccgcaacctggtcatgctgatcgagccacttcgcgcattcgccggctttcgtaccatcgctgatatggcgtccgtctttagcgctgaaactgatccacgcatgtgtatccgggaactcttttaataaatgaacgatagcttttgcttctgaaaggcacggtattgtctcacatgccaaaatatcggcgcctgcttcgattaaagcgcccattctccgcctgtgaaaatcggccaattcatcttctgtgacgccataatttccccgatattcggaaccatccgctaaaaaggcgccgtaagggcctactgaagctgctacaaacggtttaggccggccttcgcggttttccggagccgcccagaattcatcgcgtgcttctgcagcaagacggacagactcccggatgaggtggagcgcttcttgttcgctaaggccgcgttttgtgaaaccctcaaccgtcgactgatagctggctgtaatcgcgcaatcggcgcccgcacggaaataatccagatggacttgtttgataagctcggggttttcgatgagaattttcgcagaccacaggctatcgttcaaatcacagccgtaccgttcaagctcggtggccatcgcgccgtcaagtataatgacaggaaattgttgtaaagaagttcggatcggatttgtcatctcattgttgaggctctgtcgttcgagaccccggcctccttttttagagttttttaaaatatatgaaaaatagtttaaaagactcgggaggtttttgtcaatctaccaatcatcagttttcaccagtcacttttgtcgttttctatttagggtaaaaccgtatgccgccgcatacttttttaaaaaaacagataaggggtatcggatcgatgaaaaaactgattatcaatgctgatgattttggatattcaagaggtgtgaactacggaattattgatgcctataagctcggaattttaacatcagcgacctttatgacgaatatgccgggcgctggtcacgcggcccggctggctcgcgaatcgcccggacttgggatcggcgtacatttggtgctgacctgcggaaggccgcttttgtctgaccaccggacgattgtcgattcaaagggaagttttcgcaatctcgcattttatcaaggtgcttttacaatagatgccgatgaattataccgcgagtggaaaacgcagattgaaacatgcatcaacatgggcttggaacccgatcatttggacagccaccatcacatcaatgcttatccgggcatctctgacgtatttttgtcgctcgccaaggagtatcgcctgcctgtcagacgtaatatggagagcgccataataacggaaaaaggagtgaaaacgacagactctttctcacctgtccttgaagcggccttaaagggtgaagaagccgtctctgaactgtttgaaaaacataataccgtggaggtcatggcccacccggcatacctcgataaggagcttttgacgaactcttcatatacttatccaagagtcgatgaacttgagtttttaaccgatccggacgttgtcatccgcttgaacaagcttgcggatgtccagcttgtatcatttaggaatttgacataaggagaatgccggaatgaaacatatacttcagctgcttggaaagtctttgctgattccgattaccgttcttccgatcgccgggctgctgctgcggctttctgcggaggatatgctggatatacctctttttcaagcgtcaggcgtgattttgaacaatatggatgtcctgatcgcgatcggcatcgccatgggctttgcccgttcaaaagataaagggattcctgcgctgacaggatatttggcgataaccgtgttaaaagaggggatcggcatcttgaatccggaccttgatatgagcgtcttcggcggggtgctcgccggcctgatggcggctttcatttataatcaatttcaacatgcaagactgccaagcatgttttctttttttggcggagagaagtttccgattacaatgatcgtattggtgacgattccggtggcagggtttttttcggtcgtctggccttacgcagaggcggcgatcgacgcttttagccagtcgcttgttggtcttggcgctttcggtgtttttgtgttcggatttctgaaccggtttttgcttccgttcggacttcaccatgtcatgaatacgtatatatattttgggcttggacgctatgagacggcatccggagaagcggtgacaggggaaattgcacggtttttgaatggagacccgacagccggctactttctcggcgggttttttatcacgatgatgttcggcattccggcgatcgctttggcaatagcgcatgcagccagaacgagaaaaaaagaaacgaaagcactcatgtcttccggagcagccacatcgctgatcaccgggattacggaaccggttgaattcacgtttttattttcttcgcctttattgtattttcttcactcggtctatacgggacttgccggagcggtgctctgtttgctggggattcgtcacggcttctcatggggagcgggcgccatcgattatttgctgaatcttaatttgtcagacggcggattattgatcataccggtgggcgttgcttttttcgcgctctattatgttacgttttactttgtgattataaagcgaaacgttccggtgatcggaagggagcaggaaacacctgaaggagaccggctgcagcagtctatggcggcaggtattctcaagtatatcggcggccgtgagaatgtcgtcacttgtgaaaactgtattacccgtttgcgactgaaattaaaagacacgtcattggcggatgaagcccaattaaagcgattgggggcgcacggtgtgatcataattgaccggcatcatattcaaattgtgattggaacggatgcggggactgtaaaaaaagacttgcagaacttgatcgacgaatctgctccggattaaaaactgaagttgcttttgaggaatctgcgcagcatcgtacgatttttgaacaaataagcttgcacctccagcagcgtgaggctttatgatggatatgaatcgtcagttggaggtgactcttatgaaaaaagatgagtattattcaatcggtgttttctcagaaatgacagggacatccattcggacgctccattattacgatgaaatcggcctgttgaaacctgaaaaagagacgggaaccggccgccgtctctacacagacagagatgcgaaagatttgcagaagatcatatgttttaagtttctggggtacagccttgaacaaattcgcgctttcatgaaggatgcatgcttcgatgctggtctgattgaggcgctgcaggagcagaaaagggtgctggaggagaggaaggagcatattgaaacagggctgaaagcgatcgacaggacgatcggtcttctggaagaggaagaggaaatcgacagttctgttttcatgagcctgctgaacagcatccagacggagaaggagcagcgcgaatggcttgaacagcaggtgtctaaaagttttgccgatgatgtattcggcaaatcagaggaagagatggccaaattggatcaagagtatgttcgtttatctaaggaagccaagcggctcatgggaaaaccggttgatgaccccgaggtgcaggacatggcagaccggtatatgaagacgagtttggagtttgtcggagagggcgtgctgtcggctttaggacagatggagacaatagaatcgcggcagctggcagagaaatttccttcaccatttacaaaagaagaagaagagtggctgcagcgggtgttcgaatattatatgattcacaacgatttctgtcccgaaagcggcggatgaaaaaaggcagttccggcggaatttaaaacacgccggagctttttaatgcaaaagctccggctcaattttcgtcgtttgattatcgagcgaaacatgcagttcatggttttgattaaccgaagcgaaaaagatttcatccattcgttcaagccctttcttcttcagctggtttttgagccagctttctgttacattcaattgctgaaggacagacgtgtacacttttccgtcaacgatgaccggatatgaaaattcgccgctgcttttttgaattcccatatcttcagctgtgatttccattttatttggctttttgtataccgttaaatttccgttcgcctctacaaacgccatttctacgtcgctgacattgaaaacgtctttttcccgaagcatttgcagaatattatccactgaatatttgattcgtttcagattgccgacgataaacgttccgtttttgatgacgatggtcggttcaaatgtaattagacgtcccagcgttcggtatttgatcatgagatttgaagcgagtctttgcaatagggcaatcgcagccaccgcagcggcggtatgcaaatgttcaatcttcggatcggctatgtccgctccgacaacggcacccaatgtaataatgattaaaaaatcaaacacaggcatttctccgattgagcgttttcccatgaacaatgtgacaaccaataaaagcggaaggatggtaatgattcgcccgtagacaaccaaaatttctttcacagtttccattgtctttcttcctttttgtagccttttgccaattcaaggttgacggatgtcattttggagttgagatcatgatatggataggaatcggttatttctggcagccggttggcatcttcctggtttgaaatcacacgacccgccgagacaaatcgttttggggggattgtaacaccgattatttttgctcccggttcgatcaccgtatcctcctggatataggcatcaaaaacaaggctttgcatcccgacaaaaacatttttgtcaattcgaacggggccgtaaatttgacattgcggggcgagtgacactttctcgcctatgtaaatggaatacgattcacgatccttaaaaacggaatgttcagtaacagggctgttgtattcatagtttttcaatccgtgcaagacaactccgtcctggatattgcagtcatggctgatgaagatttttaatcccacgtctcctctgatcgaagagaaaggcccgatgaaaacgttgcgcccgatgaccacactgccgatgaccgaggcgaaatgatggatgtaagaggacgcatcaatgtccggaatatctgcttcttgattaaatgacgccgtgatattggggctgacattatcttgaatcagcaacttttcaagaaacttgccggcgagtgatgaaaccgttaatccaaggatgagtttgctgcttaatttcatatgacctgcctcctttattcaggtagtctgcctaaaaaacgggaatattatttaataaaagcgcggcggcggtctgaaaccaaaaaagaggatatggaggagacaacggctaataaagcaatggagtatgtttcactaatcaattggtgcgggaattttgggaaaaccgatgaaaacgggatcgcccgttttaacaaacacacggaaacgattgccctgaggatctattttaaatgaggagagattcgaatttgaagctaaaaaagatgggcaaatcgtaaagcatgcggtagagaatcataaggaagagacaaataccgcaactcctcctgccaaaaaggatagagacactggacatgtcgaaaaaacaggaggcaacccgctgccgaatacaggaaatgccggtctgtatcgtgctttactcattggacccatctttcttattatcggacttgctatgtttgttttaaaccgtaaaaagactcaaaatcaaagtgtgtaaatattccccaaaaagacggcgttacggctgtctttttcgtttgcggaacagcatttcgccctcggcgcctgcggaaacgccgagcacataagccaataaatcgctccacaaaaatccataaccgagaatgagccctccgagcggagcggctctgatattgtcaatccatggagcgtgatacagctggctgcattcgatcaaaaaacaaaacaccagcgcgatcagcgccgcggaagccgtcttcgcgtttttgaacagaaagcctgcgccgaagaaaatcatcagccacagcgcatcccctaaatatacattcacgatgtccggcagcatatcggccgtctttcttgaagcaagccccgccgccattgctgcgaatgtcagcgcaagcgggcctatccggcttcttttcatattcatggctgaaccccgtttctgccaaagcaggttaagtaaatcttcggagacatgacggatacgagaggaaaaatgttttataccttttggcgtgaagcggttttaaaatgaacgtgaaaaagccgccgtacccggcggcttttcgtgttatatcgcattttttctttcggatttttgttcggtgccggagtgctcccagcattcgatgccttcatggtttttaatgacatctttataaaagaccgggtctttgcccgctttgcgctgtttcacatagtctttcaaggcggcaaatgccacttttgacagcaggaaaatcgcaatcaggttgacgatgaccatcaggcccatgaacaaatcggcgaggtcccacacaagctggacttttgataccgatccgaagatgaccatcgcaagcacacagatccggtaaatgaagagccatgctttgttcgtgtgcaggaattcgatattcgtctcgccgtagtagtagtttccgatcaaggtgctgaaagaaaacaggaacaccataatggcgagaaagcctgaggcccatgttccgatgtgcgtgctgagcgacgcttgcgtcaactcgattccgctaagccccggctctttatacgcatcggaaaacaaaatgataaaagccgtgcttgaacaaatcaccaaagtgctcgtaaagactcctaaagcctggacaaggccctgtttgacagggtggctcgtagtggctgcggctgcggcattcggcgcgctgcccatcccggcttcattcgagaagaggccgcgtttgatcccgttcatcagggccgcgccgatggctccgcccgccgcttgttcaaggccaaacgcatgaccgataatcaaagagatgacgtccggcagtttcgtaatattcatcagcatgacgaaaacggcgacgccgatatataagacggccaggcatacgacgatatattcggacagcttggcgatccgtttgattcccccgaatgtaatgatgccgaaaacaatcgtgatgataattcccagtgtgagacggtctgtcccgaacgagttttcaaaagcgaccgttattgtattggactggaccgcgttaaacacgatcccgaaggacaatgtgatcaagacggcaaaaaccgcgcccatccagcgttttttcaagcccttttccatatagtaagcagggccgccgcggaagccgtctttatcctttattttataaatttgcgccagcgtgctttcgacaaagcttgacgccgaaccgatgatggcgatgatccacatccaaaagatagcgccgggtccgcccaaggcaatggcgatcgcaatccccgtaatatttcctgttcctactctcgcggccatgctgatgcaaaaagcctgaaaaggcgaaattccgtttttgtcgggcgttccttcctttaaaacacggaacatgtctttcagcaagcgaacttgaaagaacttagatttaaaagtaaaaaacagtcccgaagcaagaagcataataatcaatagttttgaccaaagaaaatcatttgtgacaccaatgacttcttgaaggaattgctgcatgctttcacctctttttttgtaattttaaaaaatactgagatcccattcacgggctatatgttttaaaagcattccgcccgtcatgctgtttccgtaatcgtcaatcgccggaccatagatgccgatgccgcatccgtgctgaaaaggctgttctcttttcacgctggcgggcaccgcgcacatgattccgccggagacgccgctttttgccggaatgccgacaaaggccgcgaattttcctgatgcattatacattccgcacgtcagcattaaagcttttgtcagccgcgcgacatccttcggaatgacatgttcacggcggaaaggatggtatccgtcatttgcaagaatcatgccgatcaaggcgatgtcttcagtgcttccttccatagagcattgtttcagatagacttcaagcgtttcttcaacgtctgcttcgaggaagccggtttcctttaaataatgggccaatgctctgttccgatgggcggtctgccactctgaccgaaagacttcctcattgatctcaagccgttttccaatcattttttcaatgacgtcatgaagcgactccatttttcccagtgccgattcaccgggaaggatcgacgaaacggtcagcgctccggcgttgatcatcgggttaaacggctttcccggcttgtgcatttcaaggcggatgattgaattgaacgcgtctcccgtcggttctacatcaacacggtctaatacgtaagaaatccctttcgtcaaacacgctgcgataaagctgatcaccttcgagatgctctggagtgtgaatgatacgtccgaatttcctgctttgatcatcgtttgatcagagccgatcacacagatgccgagctggttagagtcgatttttcctaaagcgggaatgtattcggcgttgcgtccgcttgaggaaaaaggacggtaatgttcgaccaaatcttcaaggcgggattgccagaagcgggcgtcatagcgttcttccaatacttcattcatcgaaattcctccaatcctgacctgttaaagcctgcaggtttgctgaaaaaatacgaggctctaaaagcggtgatttgagcatggcggcagaaggcaaaggggtaaaagcctgtgccgcacaagttgttttaaagcctgttctttcctgggaaaaaggggtttggattgcacaagggagtgagttgcggaaaaatataagcgttttcaaatagagaaaatatacattcaatttataatggaacctacataaacctacaaaaagcgacaaaaaaatttaaaaaataagccgattgatttaaaaatcaaatcgactgtgggtaaaatgggagttgcggatattgtgcgattaacgccaaaataaagcaacacgtttgtaatggaggatcagcatgatgggtggaaatcggggaagcgtgatgacaaaagcggcccggcttgttaaaaaagacggctatatcttaatggtgatgatgttaactgtgccgctggcaggagagctgaagttttatccgctgaacgagaccttcagggtcagcttcggggttccgactttcttctttcttttgctgctgctgcggaatgtgccggctgtgctgtccggctttttaacgggggcggcagtcgtcggatttcgtgtgctgcttgatggatttgggccggggcagatcgattggctgtcatccttttactaccattatccgacttttttcttttatttcacatatgcgtttctattctacttggcaaaagtgaaacgatttcaatttcgcccgctctacatcgggtttctcggcttcggaatcgaactgattgccgatggagccgaactggccgttcaatatatgatgttcgagtctaccgtcaccccgggaaaaatccgcgacatgatggcgattgctttttcccacagctttattgtgctgagcttttttaatgtcatgaagctgtatgaaacgcaatcgcgggaaaagcagatccgcgaacaaaatgagcacatgctgatgatcgtttcaaacttatatgaagaaaccgttcatttgaaaaagacgttgaagaatactgaagagattacaaacgagtcctatcagctgtacaggctcttaaatagacagagcgataacaattcctccgtccggcagatcagccagaaagtgctgcgcctcgccggtgaaatccatgaggtcaaaaaagacaatcagcgcattttcgccggactttcaaaattaatttccaaagaaagcttcagagactacatggctgcagaggatctggtccggcttgtgaccggcataaatcgaaagtatgctgaatcgctcgaaaaagacattgactttcattattcgatagacggagaacatccgaaataccatgtgtataccgtattatccgtaattaataatattatggcgaacgcggtggaagcgattcaaaagcagggctccatcagactcagcctctataggcgcggcgatgacatgctggaatgccgcgtggaagatgacggaccgggcattcccgagaaagtcggagatgtggtgtttgagccgggatacacgtcaaaatatgatgaattcggaactccttcaaccggaatcggtctgtcttatgtgaaggaaactgtcgaggagcttggagggagcattcgattccggaatgatgcaagcggtgttgtgtttacgatcagacttccggttcaacaattgattcagaaagggtgaaggcctgtgcgtttttttattgcagatgatgaccgtgctgtgcgatcgattttaaaacaaatcattgaagacgaagatttgggtgaagtggccggagaagcggaagacggctgcgatttggaaggacacgtcctgaatttgcagcaaattgatattttatttgtcgatcttttaatgccgctccgcgacggaattgaaacggttcgtcatttgcacggcgttttctcagggaagatcatcatgatctcccaggtggaatcaaaggaaatgatcggtgaagcctattccctggggatcgaatattatatacataaaccgattaaccgcattgaaatcttgaatgtcattcaaaaagtcaaggagcgcatcgagctggaacggtcgatccatgacatacaatcttcgctgaaccggcttgtgagcctcggcggcggggggaaaaacggctttagggaaaaaagcattcaggaaacgggcgaatttctcctgtctgaactcggaatcgtcggggagagcggatcccaggatttaatcgccatccttcagtatttgtttgatgatgaacagacctcattatatgaaaaggactttccgccgctcaaacagatttttcatcagattgccgtgcaaaagctcggaccggctgcttcacccgcagagatcaacagggaggttaaagcgtctgagcagcggatacggcgggcggtcagccattcgctaaaccattttgcatcactcggtttaacagacttttcaaatccgcggtttgaaagctatgcgtcccggttttttgactttaccgtcatcagcaaaaaaatgaaagaactgcagaaagactctgccgccgtcttgccctccgcccgcgtcaacacgaaaaaattcattcaggttttctttttggaagccaagcggttgagtgaaagcgctggaaaaagaggttaaaaagagcttcctctaaagtgaggaagctcttctgcatgccggttacccagcgtattctcttttcagcagtgaaaacatgtatacgtcaatcagtcttccttttgctttctcgtattctcttaacagtccttccttttgaaaggataacgagttgagaagtttgattgaaggcgtgttttcgggctctaccttcgcttcgattcggttgaggttcaagcttgtaaagccgtagtcgatcagttttttgacagcttcggaagcaaagccttttccccaatgatttcttcctaagtcatagccgatttcagctctgccgttttcctggtcgatcatattaaagccgcatgtcccgatgacttcacccgtttcctttgcaataatcgaaaagcggtttgcctgcccttcaaggcttaaatcattgatcatttggatcatgtcccgcgcttgtgagacgtctgtaaaaggcgcgatattcatatattttgtgacttccgggtctgaccagtattgacagaggacatctgcatcctccaattccatctttctcaaagtcaatctttctgtataaagggtttccatgatcttgcctccaagttccgttttatttaggaaggtgaaagaaccattcatctatctgcgcattattcatgttcataggataaaatgcaaaactgttatcgggaagcggatggataaatcccttttttatccaagatggaaagtgcaatctcggcagcagtgcttccggcagcccgtttttcaccttgaatatgaacagcaaagaaaaaagtattttcggcagtttctacatatccgacaaaccagccggcatgaagttctccgttgataactgaagtcccggttttaccggatagaattctgccatttgattcttctaaacgtatcgaatctttcacagtttgaatattagactgtttaaaatcaaattcgttatcataaaacttttttaacatattaacctgttcaagaggggaaatttgaagagagccatccagccaataattcgccggacctgagaaatcctcatttccataatggatagatttgagatagcgacgcaaatgatcctctccaatttgccggtccagtttttgaaaataccatgttgcggagctgctcatcgcagagaataaatcctggtcttgattccattctttatacggatattgagttccgtcccacgtcatttgagaattgttcttcgtgatgatcccggattccagtgcgagcaatgcgctgaacaccttgtatgtagaagcaggtgcgaatctggcggtgctttctttcctattgtatattgtatactttttcctgttagaatcaaacaggacaaaacctcctgagaagccatcaaaaaaggtgctgtcatcttcgtattctacatttgcaccagataaaaagtgcgtatctctttgcatagccaatatagatacagaaggagtgccggctagaatgatcccaagaacaagggcgaacactaaggcgcttttcacctttagcaaaggtgatgccgccttgaagttgacaactgtgacaatccgccttttgatatgtttgtatgagctgctgaattcagaagcggctaccaaagatgacgttctttgcttaagtgaagtgaattttaaaatcacctcgccatatttgagatgcaattttttatcaagcgtttttaatacggcaaagtcgcaagaaatctccatctctgtttttgcttcctttgataaataccacacgagaggattaaaccaatagacgattttggacaggcaaagaaaatagttgatgagcatatcttttcgtttacaatggtacagttcatgaagcaaaacacatttcatctcgtcggcagaaaacattgaaatatcctttggcaagataatatatggacggacaaccccaaatgttatgggggattttatcaatggggaacagcctaaaatcactttttgatgaaagcgtatttcctctttacatgtacgaaaaagggttaatagctctttgttgttaaccatttgcaggctcttttttattttgccgatttttcgattgctataaagagtagcgataagcataacagcaatgcccaatatccagactgcgaaaaaggctgaatctatcattttgaaggacgattgttcaatcgacatcgaaaaatcctgcacccagtttgcatgttggccaattgcttccgccgtcttatctgtggaacgggtgtgagatagcgttgagctagctcctcctaaattcagaatccagtcaaaatgattgctttttagataatgaaaggggagaaaaggagcgatcaatgccaaaagagaaatcacgctaagatgatagtgggtgcctacagtgatttgagccttcagcagtttttttatgagtatgatgagagaaaaaaacagagacaatagaatttgactaaccaaaaagggaataaagaaagaactgctcatttcattccttctttctgttcttatgttcttctagtatttgatacaactcattaatttcttcacctgacagctgatcattctccaaaaagtttaataccatcgaattaagagtgccattgtaaaaccggtttaaaaaactgtgacttttcacttctatataatcattttcgtctatatttggcgtataaacgaaaacccggccttctttatggtggtttaatgctccttttttaatgaggcgcagcagcatggtttggatggttttagggctccatgtactggttttggacaactctttaatcacctcattggtattgatcgaagaatgcttccagatgactttcatcacttctaattccgcatcagagatttgaggtatttttttcatttccatcatcctatacttacaaatgtaatactttcattataggtttgccatgttaagaagtcaatttaactggagtgacataaaatgtttttttcctttttttattccatcactcgaagatgatgcccccagccattcatttgtcaccggtttaaacgaggtcatcattctgtcggcattcatggccattcccctcatgaccttttcgttttttattccttccaaaaaaacggttgcatttaaaacttacgtatgtaatacttcaaaagactacacttgtaagatttgatgtttgagttggccgtccgtgttttcaggtgcaaggggttttcacgaatgttgccagccttagttgaaatgcctcttgattagcacagctagtcacgatcaatcaaatattcatacggagggagacgattttgatgaaattatggttcagtactttaaaactgaaaaaagttgcagctgtgttgcttttctcttgcgtcgcacttgcaggatgcggcagcaatcactcgaatgcctcacattctgccgagaaagatgaaaagacggagatgaaagatgattttgcaaaactcgaggagcaatttgatgcaaaactcgggatctttgcattagatactggtacaaaccgaacggtaacgtatcggccggatgagcgcttcgcttttgcatcgacgattaaggctttaaccgtaggcgtgcttttacaacagaaatcaatagaagatctgaaccagagaataacatatacacgtgatgatcttgtaaactacaacccgattacggaaaagcatgttgatacgggaatgacgcttaaagagcttgcggatgcttcgcttcgatatagtgacaatacggcacagaacctcattcttaaacaaattggcggacctgaaagtttgaaaaaggaactgaggaagattggtgatgaggttacaaatcctgaacgattcgaaccggagttaaatgaagtgaatccgggagaaactcaggataccagtacagcaagagcacttgcgacaagccttcaagcttttgctcttgaagataaacttccaagtgaaaaacgcgagcttttaatcgattggatgaaacgaaataccaccggggacgccttaatccgcgccggtgtgccggaaggctgggaagtggctgataaaactggagcgggatcatatggaacccggaacgacattgccatcatttggccgccaaaaggagatcctgtagttctcgcagtattatccagccgggataaaaaggatgccaagtatgatgataagcttattgcagaggcaacaaaagtggtagtgaaagccttaaacatggaaagcaaataaaaaaacattgcaatacattttgttaaaacatcgtcttacataaagtcacttggtgatcaagctcatatcattgtctggcaatggtgtgggcttttttgttttctctctttaaagataatgtgaagaaaaacgggagaatcggtctgcgggaaacgaccgggtttttgtcgaaatcataggcgattggattgatttgcgacaaaattcgacatatatactggcggagtgacttgatcgaccatgtatcgcgtttcttctcctatttgcaatactttacagaacgttaataaattctgcctataatagaacccgatcaatcatttgtatagagaggggtaatacgaatgacacatgaaggaccgctggaggaatggatgaaaaaactgagcgaggaaagcctcaaggacaatacgtttgaccgccgccgctttattcaaggggccggcaaaatagccgggctttcgctcggacttgcgatcgcgcaatcgatgggggcaatggaagtcaatgcagcaccgaggttctccgaatatccgtttacacttggcgttgcatcgggagatccgctttctgacagcgtcgtattgtggacaaggctggcgcccgatccgctaaacgggggcgggatgccaaatgaagctgtatccgtgaaatgggagctcgcagaagacgaacgcttccgccgtgtcgtcaaacggggaaccgaaaaagcaacacctcaccttgcacattcggtacatgccgaggtatccgggctgaaaccgaatcatgtatactattaccgctttaaatgcggcaaccagctgagtcctgtcggcaagacaaagacgcttccggcgcccggggcagatgttgctaaattcacattcgcttttgcttcatgccagcagtacgaacacggctattataccgcctatcagcatatggcaaaggaaaagctcgatcttgtttttcatctcggcgactatatttatgagtacggtccgaatgaatatgtttcgaaaacaggaaatgtcagaacacacagcggtcctgaaatcatgtcactgctcgattaccgaaaccgtcatgcccaataccgttcagatgcaaacctgaaagctgcgcatgccgccttcccgtgggttgtcacatgggacgaccatgaagtggagaacaactatgcgaatgtcatcccggaaaaaggccagtcagttgaagcgtttattaaacggcgcgccgccgcataccaagcttattacgagcatatgccgctccgccgccaatccttgccgaacggtcctgatatgcaattgtaccggaatttttcctacggcaatttagctgacattagcgtgctggatacccgtcagtatcgcgatgaccaggctaacggcgatggcaataagccgccttctgatgaatcgaatgatccgaagcggacgctgcttggagcggagcaggaggcttggctgtttgacaatctgagtcgctccgaggcgcactggaacattatcgcacagcagattttctttgcgcagtggaactttgggacaagcgcggcgccgatttacagcatggattcgtgggacggatatcccgctcagcgcaagcgggtgatcgacttcatcaaatctcaaaaactgaacaacatcgtcgtccttaccggtgatgtgcatgccagctgggcaaataatctgctcgttgattttgacaatccgaaatcggacatctttggcgtggagttcgtcgggacgtcgattacatcgggaggaaacggcgctgataaaagagcggatacggataagattttatcgaacaatcctcatataaagtttttcaatgattaccgcggctatgtgcgctgtacggtcaccccggaagaatggcggacagattaccgcgtcgtcccgtatgtgacagagccgggtgcggcggtttcgacaagagcttcctatgtttatcataaagactacacagggctgaaacggaccgcttccaacattgtgcctggaggcgtgaagaagtcaaacgaagtagaagaagaccgtttcctcgcacatacaagggcccatcagaagcaagtgaagcaaaaggagaaaaaagtaacccagtaatcaatgaaaggatgacagcaaatgctttcaaatatcggtattcctggtctcatcttggttctggtaattgcgctgatcattttcgggccttcaaagctcccggaaatcggccgggcttttggaaaaacgctgaccgaattcaaaagcgcgacaaagtctttagtctctgccgatgacaatgagatcggacaggggtctgatgcgaagaagcaaagcgatccatcggcacgatgatcaatagagcgggcgggtgaacccgtctgttcttttttctgtttaacatgcgaaggggaggaaggcgaaggtgaaaaaaagggaaacacatttgattgcccatcttgaagagctgcgccagcgaatcattaaaacgcttcttacgtttattctgtttctcatcaccggcttcttgtttgttcaggacatctatgactggctgatcagagaccttgatgaaaagcttgctgtactggggccgggggatattctttgggtttatatgatgattgcgggggtgctggcgatcgcagccaccataccggtggctgcttttcagacatggcggtttgtggcgcctgcgctgaccgaccacgaacggaggacggcattattttatattccggggctgttcattttttttattttggggattgtattcggttattttgtactctttccgctcgttcttcagtttttgatcggcctgtccgccggccattttcaaacgatgtttacggcggagcattattttcgctttatgatgaacctcacactgccattcgggtttttgtttgaaatgcccctcatcgtgatgtttttaacgagcctcgggattttaaatccggccaagctcagtaaaatgagaaaaatttcttattttgcgctgattgtcgtatcggttgtgatcacgccgcccgatttcatctcagatgtgctggtgatcgtcccgctccttgtattatacgaattgagcatctctttatcggcatttatctaccggaaaaaaaccgccgcacaacaaggggctgaggcccaaggctgaagacggactgtgtcttcagtctcttttttttttgcctgaaatgaaaaaatcagaaaataatgatattgacaatttgtttatttgtcttacaattaaacaaaaagatgaatggagggatttactaaaacagagacatcgtatttcaacagaatgacaacgctttctcagaaaatgaacgacagggggatgacggagatgagtcaattacggaaggcgccggaaggcatattgggttttccggtggcgcccttcaacagggaaggaaaactggaggaagaagcactttacgaaaacatccgctttttattggatgaagggcttgaggcggtttttatcgcttgcggctcaggagagtttcaatctctcagcacaaaggaatatgagcaaatggtcgaaatcgccgtttcggctgcggacgggaaggtgcctgtttacacaggagtgggcggcaacttaagcaccgctttggaatgggcgcggatttccgaggaaaaaggggccgacggctatctgattctcccgccgtacttgatacacggagagcaggaaggcctctatcaatacacgaaaacaatcattgaaagcacggatttaaacgcaatcatttatcagcgagacaatgcggttttgacgcttgaacagattcagcggctgaccgatctcgagcagcttgtcggacttaaagacggcataggggatatggcgttgaatatcagtttgtcatatacgataggtgacaggctgggctggctcaacggaatgccgatggctgaagtcacgatgccggcctatgctccgattggctttacatcatattcttcggcgatatccaattatattccccatatttccagaatgttttacgaggcattattaaacggcaatgaccggcttgtcaaagagatttatgagcaagtcatcataccgatcaacgagatccgcaaacttcggaaaggctatgccgtgtccttgatcaaagccggcatggaaatcatggggcttcatgtgaaaaacacggcgagaccgccgatcgttccggtggaaaaagaacattgccggcagctcgaaaacattctgaaaaacgcgatggcgcgttatccgaaaacgaccgctgccctataaacaaaaaggaggaacttgaagatgtctgttgcagctgaaagtaaaacgtatttcaactttatcaacggccgctgggtgaaggctgaatcgggcgggatggaacagagcttgaatccggcagatacacgggatatcgtcgggcttgtgcaaaaatcttcgattgaggatgtagaccgggcagttgaagcggccaagcaggccaaaaaggcgtggagaaagctgtcgggcgcggagcgcggtcaattcctttacaaggccgctgacatcatggaacagcgcctcgatgaaattgccgaatgtgcgacgcgtgaaatgggcaaaacactgcctgaagcaaaaggcgaaacagcgcggggaatcgcgattctcagatactatgccggagaggggctgcggaaaacaggtgatgtgattccgtcgaccgattcatccgcttttatgtacacagacagggtgccgctcggcgtcgtcggcgtcatctcaccgtggaatttccctgttgccatcccgatttggaaaatggcgcctgctcttatttatggaaatacggttgtcattaagccggctacggaaaccgcagtcacctgccttaaggttatatcgtgctttgaagaagcagggattccctcaggcgtggtcaatgcggtgacaggaccgggatcatcggccggccaaaggcttgccgagcacccggatgtgaacggaattacgttcacaggatcgaatcaaacaggaaaaatcatcggccggacggcgtttgaaagaggggcgaagtaccagcttgagatgggcggcaaaaacccggtgatcgtagcggatgacgccgaccttgatattgcggttgaagcggtcatcagcggagcgttcaggtcgacaggccaaaagtgtacagcgacaagccgcgtcatcgtcttaaatggtgtttatgaccgttttaaagaaaagctgcttcaacagacaaaagagattacaatcggcgacagcttaaaagaagatgtctggatggggccgattgcgaacaaacagcagcttgacaactgcctgtcctatattgcaaaaggaaagcaagaaggcgcggacctcattttcggcggtgagaggctggcagatggaaaatacgaaaacggctattatatcaggccggccatttttgacaacgtcacttccggcatgacgattgcccaagaagaaattttcggcccggtcatcgctttaatcaaggcggatacacttgaggaagcgttggagacggcaaatgacgtcaaatttggcctgagcgcctccatttttacgcaaaacattaggcggatgctgtcattcacagatgaaatcgaagcggggctcattcgcgtcaacgccgaaagcgccggtgtcgaactgcaggcgccattcggaggcgttaaacaatcgagctcgcattcacgggaacagggggaggcagccaaagaattttttacagccgtgaaaaccgtatttgtcaaaccgtaagtcagtcgtttcggtacaaatgaataaaggagaagatgctatgaaaaaaaatcgtgcagcctcccccgataccgcggggaaaagaagttctgtccgctggtttgtcgtgtctatgctgtttctcgtcacatccattaattatgccgaccgtgcgacactttcgatcgtcggcgattctgtgcagcatgagcttgggctgagttcggtggcgatggggtatgtcttttccgcatttggctgggcgtatgttgtcggccaaatccccggaggctggctgctcgaccgttttgggtcgaaaatcgtcatcgccgccagcatctttttttggtcattgtttacccttttgcagggtgcgcttggctttttcgccgcgggaacggccgtaatccttttatttgcgctcagatttctcgtcggtctgtcagaagccccgtccttccccggcaacggccgggtggtggcttcctggtttccaagttctgaacgcggaacagcttcggcgatcttcaactcggcgcagtacttcgcactcgtcattttttcaccgctgatggggtggctcgcccactctttcagctggcatacggtttttgtcattatgggtgcactggggatcgcgatgtcgttcatttggctgaaaacgatttacgaaccgaaaaaacacccgagaataaacgccgccgaactggcgtacatcgaagaaggcggcgcgcttgtctcgatggatgagggaaagaacgcggaaaaaaaagaaaaggagtcgcaatggccttatattaagcagcttttaagaagccggatgctgctcggggtgtatatcgctcaatactgcatcacaacgctgacctatttctttctgacatggtttccggtctatcttgttcaggcgcgcggcatgtcgatccttgaagcgggttttgtcgcatcgcttcctgcaatctgcggatttttaggaggattgctgggcgggttcgtgtcagacttccttttgaaaaagggctgctccataacggttgccagaaaaacgccgatcatcctcggcatgctgatgtcctgctcaatgatcatatgcaactatgcagattcgtcctggctggtcgtttccatcatgtcgcttgcctttttcggaaaaggattcggcgcgctgggctgggcggttgtgtcagatacctcgccaaaggagtgtgccggcttgagcggcggcatcttcaacacctttggaaacattgcgtccatcacgacgcccatcatcatcggatatatcgtgaatgcgacaggctcatttaacggagcgcttgtgtttgtcggagccaacgcgattgccgcggtattaagctatttgtttctcgtcgggccgatcaagcgcatcgaactgcagaaagagaaagaccctgcggacaccactttatccatgtgaaatgtaagcgctttaataagagggaggctaaatcgatatgaatacaaacatccatcagcatgtaaaagaggagaaagcatcgcaaacaccgtctattgccgacatgcgggttatacccgtggcagggcgggacagcatgcttttgaatttgagcggagctcacggcccctttttcacacggaatatcgtgattttaaaggattcatcaggcgctctcggcgtcggcgaagtgccgggcggcgagcggatccgccagacgctggagcaggcgaagccgctcgtcatcgatcagccgctcggcgctgttcaatcgattttgcagtccgtcaggcgccggtttaaagacagggatgccggaggacgcggggtgcagacctttgaccagcggacgacgatacacgctgtgaccgcattggaagcagctttgctcgatttgctcggaaaatttctcggcgtccctgtggcggcgctcttgggggaaggccagcagcgggataaagtgaagatgctcggctatttgttttacatcggggaccgaaagcgcacgacgcttccctatatcagtgaacaagaggcaaatgacgactggttccatctccgccgtgaagaagcgttgactcccgaggcgatcgtccgtcttgcggaggcagcccgagaacgatacggatttcacgattttaaattaaaaggcggcgtcctttccggagaagaagaaatcgaggcggcatccgctttagcgaagcggtttcctaaggcgagaatcacccttgacccgaatggggcgtggtcattggaggaagcgattgcgctttgtaagggaaagcgggatgtacttgcctacgcggaagacccttgcggagcggaagccggatactcaggccgggaaatcatggccgaattccgccgtgcgacaggcattccgacagcgacgaatatgattgcgacagactggcggcaaatggggcatgcgatacagctgcacgccgttgatataccgctggcagatccgcatttttggacgatgcagggatccgtccgcgttgctcaaatgtgccatgaatgggggctgatatggggctctcactccaataaccattttgacgtctcactggccatgttcacccacgttgccgcagcagctccgggcgatatcacggcgattgatacgcattggatatggcaggatggacagcgtctcacaaaacagcctttttcaattgctgacggatatgtccaagttcctgatcagcctgggctcggcattgaaatcgacatggaacgggtggaaaaagcaaatgaactatatgagaaaatgacagcaggcgagcgcaatgatgccgctgccatgcagtttttgattgaaaattggcgtttcgaccctaaacgtccttgtcttgttcgataattgcggaaacagcggtttgagaggcccctagccgacattgtcatacgcgatattttgtcttacaatatgaacaactgaaagggggcccacagtcgtggaagaagatatggaaacattgcaggtcgaatcagtcaatcgcaagactttggcaaaacaggttgttgaacgaatcgtccatttattatcaagcggccagttgaaaccgggggacaaactgccgacggagattgagctcatggaaaagctgaatgtcagcagacccgttctccgcgaagctttaatatcgctcgaaacgctcggaattatcaaaagaaaaacccgggacggcacatattttaatgataaaatcggcattcagccgttttctgtcatgctggctttggcagtcgataatttgccggccattattgaagcgaggatggcgctggagctcgggcttgtcacgatcgccgcagaaaagatcaatgacagtcagctcgaaaggcttcaggaaacgatcgatattatagcaaacagcacggataatcattatggagaagcggataaggaatttcaccggattatcgctttgagcgcgaacaacccggtgcttgaagggatgattcaatcgctcttgatcacacacgccaaaatcgacagccagattccatatagggaaagggaccggactgtcgaatatcatacgaatattttgaaagcccttcaacaaagggacccatatcaagcctatcaccatatgtatgagcatttaaaatttgtacgtgacaaaatactgaatggtcttcgtgatgaaaaaaacaatcattaagttgtttgacagcgctttctaacatgtgccgcggcgggagaagggccgcggaaaggcgctgatcgaaaaggggagttgatcaatccttatgcttgtcaatcaaactgaaaccccgttgtacattaaggtgaacgaaaaagacaatgccgcaatcatcgccaatgccggcggactgccgcaagggacggtgtttccttgcgggcttaagctgcaagagcggattcctcaagggcataaagtggctttaacagacatcacacagggcggtgccgttattcgctacggcgaaattatcggctatgccgtcaaaccgatcgaaaaaggcgggtggatttccgagtcgcatatcatgcttccggaagctccgccgctcgatgaactgcccatcgccaacaaagttccaaaacccgctccccttcttgaggggtatacatttgaaggataccggaatgaagacgggagcgtcggcacgagaaacgtgcttggcattatgacaagcgttcaatgcgtcgcaggcgttctcgattacgcagtgaaacgaattaaagaggaactgctcccaaaatatccgaacgttgacggtgtcgctgcattaaatcatcagtacggctgcggcgtggcgattaatgcgccggaagccaaaatcccgatccgaacgattcaaaatatcgccaggcaccctaatttcggcggtgaagcgatggtgatcggactcggctgcgagaagctccttccgacgaagatagagccggaaggagacgctgaaaacattctttcactgcaggaacggcaagggtttcagcaaatgatacaatcgattatggaaatggccgaagagcgcttaaaaaggctgaatgaacggaagcggatgacatgtcccgcttcagacctggtgatcggcctacagtgcggaggcagcgacgccttttcaggagtgaccgcaaaccctgcgtccggatatgcggccgacttacttgtccgggcaggggccacggttttattttcggaagtcaccgaagtccgcgatgccgttcatctcctaacaccgcgcgctgtcaatgaagaagtcggccgcgccctgattcgggaaatggcttggtatgaccgctatctggaaagaggcgaatcagaccgaagcgccaatccgtcgccgggaaacaaaaaaggcggactggcaaacgtggtcgagaaatcgctcgggtcgatcgcgaagtcgggaagcagcccgatcagtgccgtacttgcgcccggtgaaagggctgtacagaaaggactcatttttgcggcgacacctgcaagcgattttgtatgcggcaccctgcaattggcttctggcatgcatttgcaggtatttacaaccggaaggggaacgccgtacggccttgaaatggctccggttttgaaagtggcgacccggcagtcattatcagaagattggcacgacttgatcgacgtcaatgccggaaggatcgctacaggcgaagcttcaatagaggaagtcggctgggaaatcttccggacgatacttgacgtcgcaagcggaaggaaaacatgggcggaacattggggactctccaatgacttgtgtttattcaacccagcgcctgtgacttgatccgtgctagtgggaaagtagattggtatcggccaaaagatccggagatacaataggtttcaactagaaatatgaataatttttgtaaaaaacacacgtttttcaattacaatgagtgtaattgcacgtgtgtttttatgttgaaaaggatgggtgaacaagatgcagcacatattgcttattgaagatgatcattcgatcagtgaaatggtcgatcattatttaacaaaagaaggatttgaggtcgtgcttgcttttgacggagaagagggcgttcgcttgtttcagcaaggcaattatgatgcgattctgctcgacatcatgcttcctaagctgaatggaatggattttctgaaaatgatccgtgaacagagcaaagttccggttttaatgatttccgcaaaagacggggatgtcgataaagcgctggggctgggctttggtgcggatgattatattgccaagccgttttcgatgatcgaactgaccgcaagaataaaagccgccattcggcgggcaacgcaatattccgtcagtgaaccggcaaatcaaaaaatattacgtgttcacgagcttacggttgatatagaaaatgtatccgtacaaaaaaatggtgaaccgcttcagctgacatcgacggaatggaaaatgctgactttgtttgtgacaaaccctaaaaaagtgtttacaaaagaacaaatctatcgttcggtttggaatgatgattattttggcgatcaaaatattattaacgttcatatgaggcgcttgagagaaaagatagaggatgatccttcctccccgcaatatattaaaacgctttggggcatcggctataaattaggagagttttaggatgacaatgttatggattggcattctgataattttggcgtctctcaatatcgttcaatataaaatgaaaagacaacgggatcgaaacttgaagtacatcacggaaaagctcagtgtgatgctaaatgagcatgaggctgatcaaattttattaggaacggctgataaagtactgcgggctctgctcgtgcaaattaacctgtttgttgaggagcatcagcacataacagcccgttttgcaaaaacggagcagtcaatgaaacgaatgctgaccaatatgtcccatgatctgaaaactccgctgaccgtcgtgctcgggtatatcgaggcgatccaaaatgattcagacatggcggaagaggagcgtgaaagactgctggagaagctttatcaaaaaacaggcgaaatcattcagctgatgaattctttctttgacttggccaagctggaatcggaagataagcaaatactgctcactaaaatacatatcaacgaaatatgcagaaaaaacattctccaacactatgatgccgttcaggcaaaaggttttaaagctgtcatcgacatcccggataccccggtttatgcacatggaaatgaagaagcgcttgaccggattttgcaaaaccttttatcaaatgcgattcaatatggtgcagacggaaagctgatcggattgtcccttacatatgatgagacgtggattgtcattacggtatgggaccgtgggaaaggaattagtgagtacgatcagcagcgggtgtttgaaagactgtatacccttgaggaatcgagaaataaagcgttccagggaagcgggctcggtttaacaattacaaaaaggctcattgagaaaatgggagggaacatctctctccaaagcaagccgcatgaacggacagtgttttccattacgttaaaacgaatgacctattagcaaacgtaagaatttcttaagaaacaagaaataaaaaagacagcgtccatcgctacaatagacacatagcagagacaggaaaggagaaacagagttgacttacatcgtacaaacaagcgggcttaccaagacattcaaaggtcaagaagttgtttcaaatgtaagcatgcatatacgaaagggagaaatatacggttttctcggcccgaacggagccggaaaaacgaccatcattaagatgctgacgagcctcgtgaaaccgacaagcggcgaaatcaatatccttgggcataagctgacaaatcgatcatacgagattctcgggaaaataggcagcatgatcgaatacccgattttttatgaaaatctgacagccaaagaaaatttaaatctgcattgtgagtatatgggatatcacaataaagccaagattcaggaagtgctggacatggtgaatttaaaaaatatcgacagcaaacctgtcaaaacattttccctcggtatgaagcagcgtcttggaatcgcgcgggccattctcaccaaaccctacttgctcatcttggatgagccgattaatggccttgatcccatcggaattaaagaaatcagaaacttatttcaagtattgagcaaagagtatggcatgacattgctcatctcaagccacatcttgaacgaagtagagcaaattgcagatacaatcggagtgattcgggacggcaggcttgttgaagaagtatcgatggaaagcgtaaggggacggaacacagagtacattgaactcgtgacgccgaaccaattgcatgcttgctttgtgcttgaacatgagctgcagattgctaattttaaaatactaaatgataaaacgatccgaatttatgatgccgaagcttctcaaacagccatttctaaagctctgattttgaatgatgtagaaattgaatccatgaataaaaagcatacttcgcttgaggactacttcctcagcttaatcaacggcaatgcggtcaacgcataaggaggcggagaaatttgctgaatttgatgagaattgaaatgaaaaagctgaagctgggatggtatatacgcggagccgtctttgccaatttcatcatttttggttttctgtggatggtgacctgcacagaaggcaaggagacgttccaaacgattgatgaaacttttctattgatcggcacttttgttagagccgtttttatcgtattcggcgctgtgctgatctcaaaattagtgatttcagagtttaaaaacaagacaatactggtgatgttcacgtatccgatcaatcgaaagaaactgctggctgctaaactgctgatcgcaggcgggctgaccttcgttacgatattgatatcaaacgcatgcgttgcagttggtttttttctgctgaactcaatctatgggatcatccccggcgaattaacagcttctatcgcgtctcagcaggctctgaaaatgatcgtttttgcttttggcgccgcaggaacgagtttagtacccatcttttttggaatgagaaagtactccactgcggcaacgatcatctcatctgttgtaatcatcatgccgatcagttccacaggccctggcttttctatttcttcaattgtgtatatacctttatctcttgccgcagtcggtctgtttttttcctttttggctgtaaggcgtattgaaaaaatagatgttttttaacggagttgaagttcaatgctgaatttaattaaattggagtttaaaaaaacaaaattagggtggtattacaaaggtgcagtaattgcaaatctatgtattctcggtttattgtgcctgatcggatcagaggaaaaaacctccctcaagcaaaaatgtcgatggctgatgccgcatccatgctgctatttataggaattttcgtgaggtctgtgtttattgtctttgccggcgtgctgattgccaaactggtcatcggagagtataaaaacagaaccatcacggtcatgtttacatatccagtcagcagaaaaaaactaatggcagcaaaactgctgcttactggcggattgacctttttgacaatgatcgtgtccgaactgattcttgcatttattttctcgcagctcaatgatgtctatcaattcagcccggaaaaattgacgatgcatgacgtagggaatgagattggcagtatgctcatttatgctgcttcctctacaggactgagttttattccattatactttgggatgcgcaaacaatcagttcctgccaccattgtgacatcctgtatcttgaccacgttgatcggtcagcaaagcgatgaattttcacttgcttccatcatttacattccgatttcattggctctagtcggaattgccattgcgttttggtcgatacgaaaaattgaccaggaagacgtattataagatctccgtatatcttgaaggtgcaaattgacggaataccggcatttacctatacttgaagaactgaaacaacaaggaaaacgggtgaacatgtcatggaatttgaaattcgctacatctccttttacgtcatccaggtcgacggcaaggatgagcaggccaacaagcaatataaacattttcagacgctggatacagaggaatttgaaaacagcgagctgaaggatttcttagacggggaattgaaaaaaatcgtcaagcggaaagccgaacgccatccgaaatcggagcaggtgccgacgaaaatcggccgcttcatcacagagccggggcatgagcttgattctaatccgaactacaatctgtttcacaaaacaaaactggcggagacaaaggaagaattcaatgaactgagcgaacagttcgtccgcacatacctcgacacgagcgccgtcaggggaggcgtgtttttagtggcgacagccgtaccgcgcaaatacttcgatgatacatttgtctttgtcatgaagtgcgactttgaaccgaaggtcgctacgatcgccgatgaatcgtcgctgattcgcaaggtcgaaatggcgattacgacgaaaaacatgaaatcgattcagtacccgcacatgcctgaagagggcatgacagaggaaagcgaagtgaaaatccaccaggcctcgcacgcccgctactttgaagacttcttaaaattcgtcgagtacggcgagtcgatgccggaaatcatgaagtcacaagtgatgaacatggtgcaggagcacgtgtacgaagcatttgaagacaaaagcgaagaactccagcagtttgaacacgacctcgaaatctgggaagcgagcgaaaagcgggagattcaggaacgtcttgatacccaccaagtcatcgaagcctcagctcaaatcgttgagcacatgcctgaggcagagctgaaaatgaagctgggagaaaccgagattaaaggattgctggccgagttcggagactcgatccacctcgccaaagtaaacggccgctatgtggcgctcattgaagccgaaacgatttcgtttgaaaaggggagctctccggtcgagttttataaacctgagggtctgcatgaggtgattgagcggatacggaataaaattgacagggaagatgagaaataagaaaaggcatccgttttttggatgccttttgatttttcatccagatagatgagactgctaaataggttttcatgtaaattactgtttaataaggttaatataaacataatcaagccgatatagggagtatagaaagaattgaggggaggtgcccaatgcgtctcaatagtcaatacatccgtacacagctgatggtccagaatatattgaaaagaaatgcggctgatacaactttaaaaaatgtctcttccgatatcactgccgttgcgaagaaggccagcagtcaagcaggaagagcatcgaaagaaagtttgagtaagctgaactactcaaaggacagtattgtgaatcatgccggagctttcaggcgggcatacgaagcagcaaatgatcgaactgtcacagatacagggaaagaaacgaagattaatgcccaaaacccctatgtgtcagaaagtgacatcaggaaaaaaatcttagatgaaaaatacagcaaaataaatgcaatgaacaaaacgaaacccgaccctttaggctacattaaggataaatacaaaaaccccaattccccttatttcagaaatgacttgtcggcagcagaaagacaggctgcatatgacaatgaaactgagtggctgttcaaaggaaaggcgcaaagctataatatgcaggatgccgcctttcgaaatgtgacttttaatggggaagtagagacggagaatgagaaagtatatcagcgcagccaagtcaacaaacagcttcaagcgctgctggatcaatatcatattgccattccagcggatgcggcgctcacctttacgattacaccgattgattatcaagtaaaggtaagcggaacagatgatgagcaactcatccatcaaattgaacaaatattgcaatcaggagaaaacagcaaacagttatttctgcatatcatgaaaagcttgagcagcgattcggcacaatattccaaagaagcgcaccaaaaatatcagacggttcgcgagatatatgaggtgacagggtatcacctgaaagatttggaagtggttgatggccgatatgtaacaccttccggccgtgatttattagaagtgtataaagaagagctggagaaggatcccgtcctcaagaaaacggctcatctcgcaatcgctcattatggagcagagctggacaggcttgcggaagccgaatatgattctgttccggatttcatcttgtctattgactacagcaacgggtcattgcgggatacagggcaaaagaagagctatggaaccggggatacggcttggctaagagaattaaagcgccgaacgggtgtgaatgattagttttaaaagccaggaacgagtttcctttatcagggtgattttcttaataattgaatttttcgttgcgggtcttcccaacacctgttaaaataaggctaacttttaagaacggagggatttcccaaatggcatacatcagattccgattgaactttgtcctcgctaactaaatcgtgaacaaagactctgcctgtgtgcagggtaatcgggattagtctgcctgtttttagggagcccttatgcagtaatagagggagaggcgcggattccagcgcctctttttgcctttaaaaatagcatttctgaagcttgccttcagtttattagccatatcttttttccgtttactttccagcacaggcagacgacctgcgctttttttattcaaaaccttcagcaaaggggaaaatcgtatatgacaactgtaaatgagcaaattgaacatacattaaaacttgcggaaaaacacggccttcggctgaaacgaaagcatgcggaaatcaacgagtccggcatggattttcaagtcgtttttgcagaagatgaagcaggtaagagttgggtgttgagaaaaccgcggcgcgacgatgtgattgaaagggcagtgtatgaagggaaagtgctgaagctgctgcaaaaccgtcttcccgcggctgtgccggattggcgcattcatactcccgaactgattgcatatccggagcttccgggtgtgcctgccgcagtcattgacatggacatcaagaattacgtatggaacatggagcatgagcctccggctgaagcgtttaccaggtcattggcgaaaacgctcgcgctattgcacggcatcgatcataaggacgcagaagaagcgggcatgcatgtgatgaatccggatgacgtcaggcagacaaaagcagagcatatggagcggatcaaaagtgagctcggggttagcgccgagctctgggaaagatggcaaaagtggctgtctgacgactcgtattggcctgaacatacggtgtttatccacggcgacttgcaccctccgcatattttgattgaccagcatcagagcataactgggctgttggattggacagaagcaaaaatcgccgacccggctaaagactttctgttataccagacgattttaggagaagccgaaaccgcacggctcatctcttattacgaagaagaaggaggacgcgtctggccgcggatgaaagagcatattaaagaaatgcaggccgcctacggcatcgaaatcggcatgtttgcccttcaaacgaaacaagaagagcacttgaaaatggcgctggacgcgcttggcgtcacacaataaaaaaaggctgtcgatttcgatcgacggcccgttttacatcatcactttttcaatcacagcaaaaaaagcctttttttcttcctctgacaatttgccgaagagcttgtcgatcaaggcctggcggttttccaccatttgtgcggcgatcctcgttccttcttgcgacagttcgatccagacggtgcgccggtcatcgttatttctcgatctgatcacaagaccctctttctccaaatggttcagagctgttgtcgttgctgatggagacagcgcgacctcctgtaaaatttcctttatcgtacatgttccgtgtctgtaaatgatacgcaaaataaaccctttgccgctcgtgatacttttcggaatcgtttcttcgtctaatttctttgaagaccgcaaatatttcgtgaaagcatggtccaatagattcgcttcaatccgatggtgattcatgaaggtttcctcatttccgacatcgtgtagtagatcagcaatttcatactgaccaaacaaacataggtctattttatcataagcgaatgctccgcaaaaaacgattttgtgaattttaaaatgagcggtttaattccttttgttatcagttcataaagataataattctattatgaaatagttttacaatggatatattttgttttagaatgaatttgtgcgtcacataatctcaccaggttttgtgagaaacaatgaaaatttggagatgaaaattttgagtacacttcagcaattaatcaatcatcatatggaaacgtcagatgggttggaagcattgtccggaggagatcgaacgtttacgttcaaagcgtatcaccaacgggtgaaccagctggctcattatctgctggaggagggtgttcaaaaaggagaccacatcgcggttttatgtaaaaataatcatcattttcccgtcattttgctggcgtctcttaaaatcggagcgacagtcgtgccgttaagctggcagctgacatcgtatgaattaaaaggaatcttgaacaactgccggccgaaggtgatgttttatgacttggaatttgccgatatactaacgccgctccgcgaacagcttcagttctgcctgatgattgaagcgggtgcgggaatgaacacgactgaacagtttgagagcttatttaaaaacaggccgctgaaggtggaagctgagcaggtgacagagcatgatttggctttaatgctgttcacctcgggcacgacgggaaacccgaaaggctgcatggtcaaccacggcagtctggccgcatacttgacagaggtgaacgtgaaatcgaagcagctgaaaggcacgcgctttttagcgagccacccgctctatcatatgagctcgctcaaccatgtttttcaggcggcttttgaaggaattgccctttatttcttatgggatcccgaaccgtttgaaatcctgcaggagatcgagaagaaacgcattcatatgatgatggcgtttccttccgtctacacctacatgctggaggaaatgaaaagacatccattcgacctgtcatctgtgaaaatgcttgtttccggcggcaccaaggtgccggcgcggctgattaaggagtacaatgaccatggaatcatgatggtgcaggggtacggcagcacagaagcatggacggtcagcgtatggcggcctgacatgggctgggataaagtcacttcagccggcaagccgattccgcaagtcagcataaaaatcgaagaccctgatacacatgaagagctgccgacgggagaagtcggagaagtcgtcgtcaaaagcccgtatgtttttgaagggtattaccaaaatccttccgccacgcaaaaggtgctgaaagacggctggttctatatgggggactccggcaaactcgatgaagacggatttttatatattaccggccggtataaagacgtcattgtctacggaggcgacaacatttatccggaccaagtggaagaaatcatcgatcaagtgcccggagtagttgaatctgccgtcatcggcgtcccggatgaaatgtacggcgaggttccgagggcgtatgtggtgaaaaatgaaagcgccggcctcaagaaggaggacattatcgcgtattgcaaagagcgcctgtccgactataaaattcctgaaatcgtctttatcgacagccttccgaaaaacaggctcggcaaaatcgtcaaaaaagatctgcgtgaactggcagtcaaagggcagtgagcgcaatgattgaccgaaagcttatccagcattggataagctttttttgctgattccttgcatcagctgccgttttttgtaacgttttccagtgctaaacccactacaacattaggaggtgttgacaattgaaatcgaaatggagtgcaatggtggttattgccggtcttttattgctggccggatgcggtgcactgaaggaggctgatcccccgcgcggcagatcagcgcaaaaaacggaagcctcgttttctgaagctgaacagcgatttgcgctcgccttgtttcaagacatgataaaagaagaagggagccggaaaaacatcttcctctcgccttacagtattcagcaggcacttttgatgacggcaaacggtgccgcgggagacagcagaaaggaactgctcagcactttacatctcagccaggcggatatggcatcgatcaacgggatatcaaaatctgttaatcgttctcttgaaacgctgcctcacggtgaattttcatcagctaattcgatatggaccaaaagggagctgaaagaaagctttcaagacgcgatcaaaggccttggcgacgcctatcagcttcaaattgatcctaatcgggcaacagaggaaatcaacagctgggtcaaaaagaaaacgaaagaccgcatcgatcagatcgttgataaagtctcgtcgaatacgattgcctacatcatcaatgccgtctattttaaagaaagctggaagcacccatttgatcctcacatgacagcggaacagccattttattcagcggacggctccgcaaaaaaacaccccatgatgacgcagacaaaccgctttccttatctggaaaacgaacattttcaagccgtcaagctgccatttcaagacgaaggcctgtcactagccgtttttctgccgaaaaaagcggcaaatctagaacagcttctgactggcatgacgcatgatcaatggcgcgccttgcaaaagggctggacgatgaaacaggtggagctcaagctgccgcgcttctcatttcaaacagactacatgttaaatgaaccgcttaaacgccttggaatgaaaaccgtgtttagcagcgcgaatttttcaaatatgtttaccgggcatggcgccgctcaaattaataaagtcagacataaaacatttatcaaagtggatgaagcgggcactgaagcatccgcggcaacggcggttgaaatcatcgaatcagcccccgtccctgaagtgaccatgactgcagaccacccgttttattttgcgatcgttgatgaagcatccggaatgattctctttttgggcagtgtggcagagccgaaagatgattaaatctggggaaataccattattttataaaaattcattaaacttcctgttttattaccgatattaggaagggagttcctttatggtgatgaataaacaggaggcaaggacaaatgaaaaaaagtttgtttctgttcgtgttcagtttgtttttgatggcgattccagcattttcggcttcggcgaatgtttacgaagatgagtatgaacccaacaattctttcgctgaggcttacgatgtagggttgtggaaatacaagacgatttcggcgacgattcacagcgaaagcgataaagattattacaaattttacgcgacaaagggagaacagcttgccattcacctaaagaacatcccggcaaatacagattatgatctatatttatttaaagatgcttacggctatcccgcagtaggatcttctgaaagaatgggaaaccaaaatgaaatcatccgcttggatgttcccgagacaggccgatacattgcggtcgtcatgtctaaagacggttcatatgacggctggggattttacagacttgaatttatcgacagaatgaagagcggtgcttatacggcgaatttgtctccgtcatccatctcaagcccgggacagggagtcgtttctccggttgccgccgtcaatcttgccaatgcctcggccattcccgaaggagcgactgtgaaaagcgtttctgccgagggaacgatatatccaagtctcggacacacctacagagaagtcctgaacaaggaagaaggcgtttggcacacatcggtttcaggcggcacactgtttccggatctaaagcctgaacttgcgcttcccgtcaaaacgacatggaatgtgagatactattcgctcgcttggagcagttcaacttggagatcgccgcagctgaagatcaattatcaatacgattcaacatacggctggtaaacagatccaaatcccggccgatataaaaagtaatagaatgtaattggcatgaaaggagctcccatgaatattagagacagggtaaaactttcgctttattccgagcagctgatgaagccggccgccgcgaatgtgccggcaaagactaaaggctccaaaaggatgcccgccagccaaacagacactctctccatcagcaaacaggctgaatcagcccaaaaaaatgcaccgtcattacggtcacaaatgaacggcgttcaatttgagatctataatctttatgtggacaggcagcgtttgaacagccagatcgaaggggcgctgcgggagagcggaatttccctttccgaaagcgaacatctgacattgcatgttgacggacataaccggattacagttgaaggcatcgaagacgaacaaaaaagaacccgtatcgaagctgttttaaacgacagcgataaacggttcggtgcgcgtctgttgggccacgcagaactgatcggtgaacaaaacggaacgccgctggataaacaggcttacgaaaaatggcatgtgaatgagtttttgaaaacggtcgccgggctgtctttggctgatgtcagtttggatgaaagaggagagcttgaaggcggaaatgagaagctcaccagagtgattgaatcagccaaagacccgaaaagcgacttggagaagagttttcaaaacattctgaagaagctgaagaatgtcctggcgaaagggccggacaccattccggacaggtcggcttctttcggctatgccggcggaacgcttatcgatctcaatgtatcaaaaggattctccgcgggccagctgaacgagtggctggatgatccgtttcttagagaagtcctgctgaacaatttttaaaagacctggcaaagtgattttgccgggttttttgtttgcataaaaattgcacgaaaaaaatttcaaatttcgcattgaccctcacgttgcgggatactttatagtcaatatcgaagggaggtcagatggatgaaaatgaaagtaaaggaagtggccgatttagtcggcatcagtgtgcgcacactgcatcattatgatgaaatcgggttattagctccgtcggagacaaccgaagccggatatcggctgtattcagatgacgatctggaaaagctgcagcaaatcttatttttcagagagcttgacttccctttaaaaaagattaaaagcattcttgagaacccttcatttgacaagaatgaggcgcttcagctccaccgcaaagcgctgctggagaaaaggagccggcttgaccaaatgattgcgacaatcgataaaacgatccaatttgcgaaaggagaaatcaacatgacaaacgaggaaaaattcgcgggttttgatttcagtcaaaacccgtatgaggaagaagcgcgggaacgctggggagatgaagccgtcgacagatcgaaggcctatatcgaatcgatgtccgaaggtgaacgaaaaaaaatggaacagcaatatgacgccatttacagaaaaatcgccgctctcagagaaggcgcccccgactcagaggaagcacaggcggctataaaggaatggtacgactttctgaacaataacaccggccacagctattcgctggaagctttcaaaggtctaggacaaatgtatgtggctgacaagcgctttacgaaaaacatcgatcaatacggcgccggcttggcgaagttcatgtgcgacgccatgacggtgtttgctgacagaaatcaggaataatcgctggaaaccgcctgataaggttgtgaaatgaccttttaggcggtttttttagattttaatgtgagatattccttttgggcaatagcctgtgctgacttatttgatttgcaggctgattgctgtgtttgatttgtgtcgaatcgtctaatatgctattatatcgttagtcgatatatcgtaagacgatacaaaatgaggaggcaaatgatttgaatacataccttaccgggattttatttgttttgagcggaattcttttattaaatctagcggttttatcagggataaacggtgtattgtgggggctggttcttgggggcagcatcattttcaatctaataggtgttgtactgctcatgagatatataaatgaaaaaagccatacttaataatgaggtgcgaaaagtgatgaaaaaaacggcggaaaactatctaccgcttacgcaggctacatattacatattattgtcattaactcaaccattacacggctacggcattatgcaaagggttgagagcatgagcgagggagaggtcaaactagggcctggcactctttatggtgcattaagcaaactcgaaaagcaggggttgattaaaaaggaaggcgaaaccggcgataatcggagaaagcagtatattttaacgaatgaaggatgggcggttgttgaactcgaatttaaacgtctgtctaaattggtggcgatcagtcaatctatttttcaaaaagagggagatacaagcaatgagtaaaaaaagaaagcgtaaattccgtttttttcttgcctggcaagaccggaaggaagaggactggctgaatgaaatggccaaacaagggtggatgttaaagtcattctttttatttatctatacatttgaaaagacaaaaccaagcaatacagtatatcggctcgactataagacaacatcaaaccttgatcaagaagaatatattcatatttacgaagatgcaggctggaagcatgtgacacagtttttaaattggcattactttgcggctgatccgagtcaagttcaaacaaatgtgatttatacagaccgtgaatctgaagcggaaaaatataatggcttactaaaagtgttatatgctgcacttgccagtgtatttctcagctcgggacttccgattcttatcataggcatcccgggatatttttattggatagcagcattcaatctctttgttttgtgcctgttgatcgtgtgtatattaaaggttcgtagaaaaacaagaatttgacgctgtttgacacccgctaattttcagagtaatatattttttacaaatcatgtacggctaaacgatattgaagaagagcaagtacgtgtcagagcatgggcttaagagagtcggtggctggtgtgaaccgatgccctcctgatgccgaatgggcttctgaatcgcttcgctgaaacgggcagtaggcggagccgggatgttctctccgttatcaagagaagcgtatcgaaagggctgactgtcccctttccgtatgttccgagcgaatcgtttatgcgattaataaaggtggtaccgcgagaccctcgtccttttgtgacgggggttttttgcatttttaaggaggtggtggccatggaggaaggctggccggagtggccgcataatactaaacggaaacggaggtgtgatcgtaaatggtgattgcaacggacgatttggaaacgacatgtccaaattgcaatggaagcggaagagaagagccggagccttgtccaaaatgttcgggaaaaggcgtgattttgacggtgcagggcagcacattgctccattttataaaaaaacatctcaacgaataaaaaggacgggtgtttagagttgagtcgagcagagaagagtacagctgagcagagcggccatattcaacacggtgttcgaaaagcggccggggtcgtttttatggtctttgggacgatgtgttttgcttcaaaatccatttttgtcaaatgggcttatgaacaaggtgcacagccggaagcggtgctgttgtaccggcaattatttgcggcgccgctgttttggctgatttttattgtgtatcgctcaaagcttccggctaagcctgaaaaagcggagatttttaaagcttgtgcggccggattgctttgtttttttctatcgccattgcttgattttatcggccttcacggtgtttctgcaaccgttgaacggatgattgtgatgagctaccccatgttcgtattgatcataaccgcctttgtaaataaaaaaatggtctcgggtaaaacgtttgctgccatcttgcttgtgaatgccgggctgtttttggctgtcggcggatgggatgtgcaagcattggaagcgaacctgtcaggggcttttttgatcctattgtccgctgtcgcttatgcggcctatcttgttgtggcgggaggacttgtccgtcaaatcggagggattcgaatgaatgcctatggaatgtcggcagcaagtcttgcgatggccggttatgcgctgcttcgctcgctgagagaacaaccgggaatcgtgctttcttatcctcccgcaatgtatggtttttttatgatcattgcggcggtgacgacggtcattccttttttattcatgctggaaggcatgaagcggataggagcggaacgaggggccgtcatttccatgatcggccccgtcctcaccatcttcggaggtgttttgtttttaaacgaacgtttaactcccgttcagtggctggggtgcttgctagtgcacctgacggttagtctgctggaataccggaaatagagaaagggattcatatcccttttttatttctgtttaaatgaataaaggtggtttactcagtgtcggacgttttcatgacatatgttctagccgcgaaatcgtggaccgcttgtttcgttcctgaaaaaacgacggttaaatacagcagaccgaaaaagatatgcacccatgagacgatgtagcgcacgaaagcctgccaaagcttaatccgtcggcccgtatcatcagaaacgatacgaattctaaaaattgcttttccaatcgtgccctggagctttgtcagcggcatcagaagcggatacaaaacgtataccagcagggcggctgcagcaacttcatgagatccgtcgccgaatatccatgcggatgaaaagtgtaacccgaccgccaatacgcaatcgatcaaccatgcacccgctctaacccaaaaacgagcgtattgcaatatgtataacatcctctctattataaatgaatgataaaaacacaacattaaccattttatagtctttttttctatttttaaataaaccttttggcctcttttataaaattttacttttcagctaaatcatactgattttcattatcggatttccccctcctgaaagttttgataaaataaataagttgtagtataagatacggaggtttaaacgtgggaaaagtaaaaagaaatatgccttgcccctgcggcagcgggctgaaatataaaaaatgctgcggcaaagcagagggagcgtttccggctgtcgcggtgcaagaattgaaacaaatccagaaagacgtcatggaattcgcttttacggaacataaagacacaatcgatcaatttctcaatcagtattcttttctgtcagacctggatcagtctgcgcaaaagatatgtgtttttaacctgggcgtgtggggagtatttgcccgcccgctggcagatggaggattgacgatttttgaagactttttacagaaaaaaggatcttcgattctcagatcgcagacaaaggaagccgttcaatcgtggaaagacctctcccctgcgttgctgcgtgtgaaacatataacagatggcggcattcgctttgaggatgctgtaacgaatgaagagctgaccgtgaggatgaatgtgaaacgggaagggccttttgtaggcgagtacgtgctcggctttccgatcaagatcggaagccataccgagttcttcttgcaattcaccatctatcctgcaaaaatggcggatgctctcaaagacaggctaagcgaggctttgaaccgttttacagaagaaggcgggacgaaagagcagctgatgagagaggatttccatcatgtgttaatgcatctttgccggcaggaagagagtacaccgtctgaacaagtgtccgaagacatcgaatgggccaatgagatggaaaaagaaacagcgctcgtttttgagaaaggtatgcttgacgaaggacattctgaaccatttgtgtcctgggcggtcggcctttggaaatcgtattgtgccaaaaaagcaccggtcatcaaaaaaacagaagcctttgcagctgctttggagtattttatcaatacgatctccaaatcggaaaaatcgatatcccaagcaaagcttgcaaaaaaatacggcgtcagcgcttcgaccgtatcgaatcgttttaaagatattgaagccgtcctgcaggatgaacttgaccatcatcttgagcttatgccatcttaaaaaagctcacacaactgctaaaccttccggggaaccggaaggttttttgcgtttgattctgattaaatcttgagaaagatattttaagatatcggtacgatcagatcaaacaaggagagattatgatgagtacaattctactggaaacaaggcatcttcaaaaaaagttcggaagatcgcaagcggtctcagacgtctcattgtcagttgaaaagaacagtatttacggattgcttggaccgaatggagcaggaaaatcaacgactttaaaacttttaaccggaatcttaaacccaactgccggggatattttgtttgaggggcggcaatggaaaaggtccgtattaaaagacatcggttctttaatagaatccccgcctctgtatgataatttaacagcctacgagaatgccaaggtgcatgccgcattattgggccttccagatgcgagaataacagaggtgcttaaaactgttgatatgcatcataccggaaagaaaaaggcggggcagttttctatggggatgaggcagaggctggggatcgccatcgctcttttaaatcgccctaaactactcatacttgatgagcctactaacggtcttgatccgatcggtatacaagagttgagggaactcatcaggtcatttcccgaacaggggatgacggtcattttatcaagccacattttatcggaagtcgagcagatcgcagaccatatcgggattatcagcggagggtatctcggatatcaggggaaaatcaataagggagacgatcttgagcggctttttatggatgttgtcaaatcaacgcgggagaaagagggcggagaaaagtgatcggatattatgtaaaagcggaaaacctgaagtttaaaagaacattttcgagaaaaatgatcttcattgtgcctttgattaatatttgcttcgcctttttaatgaatccgggattttttgtagcaggtacgtataattggtggtctgtcatcttaatgccggtcatgatcgccttgctttgtgcacaatcacaccagaaagaaaagaaagcgtcgaattataacggcattttttcttctcctgtagatttgcatcagatttggtatgcaaaaataagcgtcattgcgctctattctttagcatctcaagctgtttttttaggattcatggttgggatgcagtttgtcattcctcaattttcgagcattcatttgacagtcattgccgcgaatctgctgctttggctcacgacactatgggagatccccgtctgtttatggatagcgcgaaagtacgggtttatatctgccgttttgttcaatatgctgggcactatcatattgggcatcatgtcggcatcaagccctttttggtggctgaatccttggagctggccgatcagggtcatgtgcccgacaattggcatccatccaaacggtgtgcctcttgagaatggcgatcctttaacgagctgggcagtcgttcctccggctgttgttctatctgttctgttatttgctattttggcgcgtctgactaggcggtctttttctcctgccgttgatcgcaaatcgataaaacgggaggcggtttaatttgttgttatttttcagatgcctggcggctgattttcaaaaaacaaagcgtacgtcttttatttggcttcacttgagtgttccggttatctgtgcgggtgtttttctgctttatttctataacagacagcccgatccatatcaattatatcgcacgtattttgaagccattgcgattgcattgccgcttctgattggaattgtgtgcggaatgacggcttccttagaggagcaggcaggccgttttcaagtgctgttgggcggcacggctcccaaattaacggcttatttaagcaaagtcacgctgcttctgatcatgaacatttttgcggtattcttggctattggactctacttattggggctcagagctctttttcatgtgccgaacctgccaagctccctttttttagaggctggggcatggctggcagccggaagtgtcacactttatttcatatactttttgatcagctgtacattcggaatgggggcttcgattttagcaggcggggcaggccttttgatgacagcgctgatgaacacgggattgggcgatgtcatttggaaatataatccctgggcatggggaatcaggctgacagggtataaggggattgaccgatttgtccaaattgatccgtctctccgctctgttctagatggggaaatcaagcagggggctttcatcatggtgtttgctataatagctgtattcgctctaagcatcatttggtttatccgctgggaaggaagaaaagcttttgaataatgaaaaaagggtggtcagcaagtggcgaaaattttggcagtagatgatgagaaagatattcttgtactcatacaaaatattttgcgccgcgatcagcatcaagttcatacgctaagtcaagttaacaccgaatctctcgacgtgttttcagggtatgatttaattttgcttgatgtgatgatgccggggatggacgggtttgaattatgcgagaaaatccggccgctggtagattgtccgatcctgtttctcaccgctaagacggaggaagaggccatcgttaaaggcctcctgactgggggagacgactatatttcaaaacccttcggcgttcttgagctcagtgcaagagtaaatgcacacctgagaagggaaagaagagagaaatacgagactaaacgggtgatttccggttttttatttcactttgacagcaaagaagtatttattcatgatcaaaagctgaatttaacaaaaaatgaatttaaaatatgtgagctattggctcagcataaaggacgaacctttacaagagaagaaatttatgatcatgtatacgggctggaaggcaatgctttatattcgacgataaccgaatttatccgcacgattcggaaaaaatgcaaagaacacaatagagatccgatcaaaacggtatggggcgtaggatacagatgggaataatccgcaaaaaaaagacactgcgcagagaactgatcaaatatatgctcactttgagcttcagcctgatcgcgatcacggctttatatgttttggtcaatatgataggaatgaatgcagggctgttttatcctgccaactacaatgaaatcgaagctgaaaagcttaagcccaggcttcaatcggctgaacagataacggaagacatgataccggatacaatgctgtacgccatactggacaaaaagtcgaaacaaaagacagcgggaaacatgaaagagacgaatctttcgattgtacggaaaaagatagagagcaggccttatgtcagctttagtcaaaaaggctatatgattatcgaacgcaaagacgagtattgtgtattggagtatcctttgcgcgctgagtttcggtctccactgctgagacggtttctcccgaactatgagctgacaagcatatgcatcatcgttcttcttttaattacggtcgtttttacggtgacaacccgatttgcaaacagattaaaagaacattttcaaactttaaacaccattgccgagcaaattaaaaaacagaatttaaattttactccggagttctcgaatattaaggaatttgatcatgtaatcagttccctgatggacatgaggaatgccctccaagcctccctacgggcgcagtggcatttagagaaaacgaaaaaagaacagatcggcgcattggctcatgatattaaaattccagtgaccatcatcaaaggaaatgcggagttgctgagcttatctccgcaaaatcaagagcagtcggaatatatcagatacatccttgacgcggggcaaaaaatcgaacagtacattgaccaattaatccatctctcaaaaactgaggaagcattacataccgagtacagagaaggcgctgtgaaaacgctagtcgaaagtgttctccatgagactgaagcatatatagggaacaaatcgattgacattgtgttgaaggagcagaaccttgaaggaaaaaaagcagtgtttgacaaacagctgcttcaccgagcgttgatgaacatcatgacgaacgccgcagatcacacaccagaaggcgggagaatcgattttgaagctgtgtgtacggctgatcaattgattttcacaatcactgacagcggaaaagggttttctcaagacggcctgcagaaagctgccgagcttttctatatggaagataaagcccggacatcgaatggtcattacgggatgggacttacctttgcacttcgtgttgttaagcttcatcaaggcgatttggcgattaaaaacagcgaagcaggaggcggacaggtacaagtgaccatccccctctgagaccagatcatcatttccatatctcgtcattctcataatcaaaaaccttccggcatcggccgggaaggttttttacggttctccaagttcctgtttcaaatattggtacagctttgcatcagcctgtttcagcggaaacgccgcggttttgcaaaggatgccgaaggttacgctgatcgggtcatcgtcgataaaccggacaatcgttccgggaggaggaggggaaacgatgcttttcggaatcagggcaacgccgagtcctgcggcaacatagtttttcaaagctgtcatgcttccgatctccatcgtgttcatttggctccccggcagctcttgaaacgcgatttcgactttcttccggtaggtgcaattgttggccgtaatcagcaggcggtgctccctaatatctttcagatgaatgcgttcattgtttccggcggggtgtccctcagggagcagcactacgagttcttcagcataaagcggttcaaaataaagatctgttcccattgccggagtcgaacagacggcaagatccaggcttccttgaaccagccgttcccccaatgccgacgagttggcgatatcaacggaaacccggatcttcggataatccgctaaaaatctccccaaaatctggggcaattcacagctcgcgatcggttcgaccgctccaaggcggatatttcccccttcgccaagcaataagtcggccatatgatgttgaaggtgatctatatccttgacaatatgtctgctttcttcaaaaaaaagcctgccggcttcagtcagacggaatgttttccccctctcgagcaaacgaatgccgaggtcttcctcgagctttttgatttgcattgtgaccgtggactgcgcataattcagttcttcagccgcgcggttaaagcttccgcaagccacgattttatgaaacgtctttaacgttttgaaatccatcccatcacctcaagttcaataaaattgaatgaaaccttcaaatgattcaattatacaaaatgatataaccgttatacactattaaacaatacaaaggaggaatgaatatatgccatttgtcaggatggatcttttaaaaggaagatcaaaggaagagcttcgccggatcagcagatcagttcaccaggcgatgacggaggcgatcgatgttccggaagacgattattttcaggtcatcacccagcacgatgaggaagagttctttttcgatcctagctatatgaacatcaaacggacgaaggatttgatttatattcacatcacaatgaaagagagaccgatcgaaaaaaagctggctctgtaccaacgcattgcagagcgtttgcaaaaaaacgccggcatccgccaagaggacgtcatgatcattgcagccgaaaacgtgaaagagaactggtcgtttgggaatggaacagcacagcttgcatcagttgaaagggagcgttgaaaaatggaaatgaaaaataaaacagcccttgtcacaggaggcggcacagggatcggcagagcggtatcgctcgctttggcaaaccgaggggcagcggttgttgtcaactattcgcgttccaaagcggaggctgaagagacggttggaatgattgaaagttaaggcggccgcgcgctcgcggtgaaagccgatgtttctaagatcagtgaagttcaagacatgtttgatcgggcggtgggcgagttcggtaccgtcgatctgctcgtcaacaatgcaagcatcaccaggcatatcgagcttgatgacttggaaggggcttctgaagaagtctgggatgaactgtatgcggtaaatgtcaaagggatgtttaattgtgcgagagcggcggcaccttttatgaagcgaaataaacaaggcgccatcgtaaatgtcggcagcatcgccgggcttaccggttcaggctcttcgttaccctatgccgtatcaaaagcggcggtccacggtctgacgaaatcattggcgcatgcgcttgctcctgatattagagtcagctgtgtggcaccgggcgcggtatcaacgagatggtgggaggggaatgaagagaaaatgaagcggctcagccaaaagctcccgcttgagcggatagcggaaccggaagatatcgccttgctcatttgtgcgctgctcgaacaagaaacagttacaggccaaatcttaacggctgactgcggtcaaacattatagcgattataagcctattatcctatttctatatgaaaccatttaccttatgataaatcatatcgaaatagaaaaaagagggaagaacgtatgaggcgtttacaatcgttagaagccattgaaaaagtaaaaaacggggattatcatgttttgcgggatgccgaatggctgaagtatctcgttttaactgaagagcaaaatatcaacctggagcggatttcttcgctagagaacatgcctcagaatcccgtttttctttatgttgaacagacgctctctattttggagaaagctgacattcctgagctggaaaaagaaatcattgaagaggttctcatatggagtgaagcggctaagtgcggccagcctcataaaagaaaggaatggcgtgaaaaaggttttcagcttgcgatccataatatcgggtcggcgcagatttatgctgatcgaagacaggcgtacatgccggaacggcaggatattgaagaactcatccatattttgattgtgacgcatggactcgtcggacggtatatccgcggggaaacaaggtatcgccaattcactcctcttatcgattggattgaaacatctgaacttcagcacatcgatatcaggcgggttctatacgtgctgaacaaatgtatcattgaagcggtatcgccggcgctttgggattcgatagaacgagacgtgaaccgggtaatcggccaaatctgcacaggagaaagaaataaagactggccgtttgcggaaaggatcagaaaactgcggggacaagcgctcgattccggtgaagacagcagccggtacgagcggtttttgagggagcattcggcggaagatacgctgagacgcttctttcagcggattgatttatggtatgtggaatccgccttgtcatcattcagttttgaagagtttgtcaaaatctttctgctcgtgcttcgttctgtcaaccctttatcagtcaagcacatcagctttgagccgctgatgaaggacatgtaccgtgattaccagggtgtgaggcatataaatgtttataaaaaacgaattatcgaagcgtgcttaaaagagatgtcgatcagcgatttgctttacggcgaggtgcctgtaaatgaacacgtttcgcttgctgttcagccgtttgatcaggcttctgagattgtcggcgtcacgttttcattttcgcaggcaggactgaagctgattgaattttgccaggaagcggagaaatcgcctttatatgaacgggcgatcgtgctgctttatgatttttttgagtttcgcaaggattcgtttgaccggctgcaaaatgaagcggcttatctgtctgatatgaacggtgctgaagattataaaaagaagattgccgattatgccgttggagaaagaatgctcgacatcggagccggaggcggcgtgatgcttgatttgctgacagaccagcatccagaagcagaggtcatcggaatcgacctttccgtcaatgtcattgaggagctccaaaaaagaaaagtgcgcgaacataagccctggcatgtgaaacaggctgatgcattggacctgcctgagtactttgagcaggaaagcgtcgacaccatcgtattctcatcgatattgcacgaattgttttcatacattccgtatgaagggaaaaaatttaatcatctcgtcattgcccaagcgttaaaaagctcctttgacattctgaagccgggaggcagaatcatcatcagggacggaatcatgaccgaaaacaaagaggaaacgcggcggatacggtttaaagacccggatggaatggatttcttgaagcggtatgtccatgattttaaagggagaaaggtgcaaatgcttgaggctgagaaggacgcggctgtactgtttgtgaatgatgcaatggaattcctctatacatatacatggggagaagaagcctatccgcatgaagtgcaggagcagttcggctattttacgccgtctgaattccgccgctgtatcgagaaagaattaggggaacgtgcgaacattctggtgttcgaacactatgtgcaggaaggatatgaagaacacctttaccctaaaatcgagctgacagaccggctcggccggcgtgtgccgctgccggacagcacttgttttattgtaattgaaaaaaagcacctctagggtgctttttttagttgttgcttttaaggaagcttgagaagtattgttcggtcttgtaattatcagcatcaattttccatttgtcattttttgatttttcaagtttgacttcaacggttttctcacttgaagtcgcctctgcttttttgatttcttcactcatgatgtcaatcgcaggattgatcaattcatctctggacatgaagtctttgccgctgtctttcacatagtcttccagtcttttcttcactttcttttggacatctgtattatcgattggcgtaacggttgcctcaacagttgcttcatcgcctgaaattgattttgtaactgctttgacttgagatttttcttgataggcgttttggatggcgctgatcagtttattcaatttctttttatccacatcttcttcatcataatatcctaaagagcgaacgatagatttttgagcgccttcaaggtaatcggtaacgacttcacgtttgttttcgtcgaccagtttatcaaagttattattgtctttgccgaaaatcgttacgtctgtgtaagctagcaaagcttttgccggatcttcaagttttttggccgttttcagtaattcgtcgctgccgccgtcgatctcgaatttgacaggatcggctttattttcaccgtacatgtcaggtgtgtattcaagctgaaactttttgcctttttcaacgatgtaatagatatttccgtcgacttctttgtcagaattcagcgtcgaagagcgaagccttttgtttctttcatcatatacgctgacgtccgacatttttgagtcgccttcgtaaaggctgaattggcttttatcaaccattaatggttctttccctgtatttttcacggaaacattgatctttagtataagttcattttcgtgcaggtttgttgatgaatcatcaggaagcgtatattcggagcttaggattttaacttctgcattatctgcttttttcgtatcttctttctctccgctcgcgcttttgctgcctccgcaggctgttgacacgactgctacaatcatcaaaagcatcatcagaaaaaactttttacttcgcatggtctgtctccttttttattatttttttcaatgttatgtaaatgaaaagaatgaggcggccagggcataaaggcccttcatcgggacaaatcttactcaagtcccggtcatttcatttatctaacagtgaaaatttgattataattcttcctttttccttagtttctttaaaaaaacagaaacaacatcactcattttaaggtttgaagaatcattaataaataggtgttaaatactaattttggtcaatgatttgcaggattaggcatgttttcaaactttggatagtaagaagagactaaaactaatgacatgcacttcggtgcatttaattgaggtttatccattttttactttagatcctggtcagatcaggttaaaaatataagtattttttttaggagacgcccttatgttggtgaatttcaaatttgggccatagtgtataaaaagtcccgttttcgggtttccttaacctgagcttaaaatttagtagatcaattgtcttagaaacggcggttttgatggtgtaaggcttttctatagtcagagagatggaggcatatatgggggaatgcagccgggggcaccggctgcatattgtggaccggatgtttacttaataccaattatcatagcgataacaatcgcagcggcgccgatgataatccagcctgcgatcagcttccagacaaacttgacccagcgttcataagggacgcctgcgattgacagtgaagccagcaatacgccggaggtcgggatgattgagttggtgatcccatctccgtattgataagcgaatacggcaatctgacgttcgaatcccaataaatcggccagaggcgccataagcggcatcgttgtggctgcctgtccgcttccggatggaataaacgtgttaatcgcgatttgtacggcgaacatgccgatggcgctgatttcattcggaagcgagctgattgctgaagcaaggctgttgatgatcgtatcgataatatgtccgttttccaatacgatgacgatggcacgggcgaagccgacgatcagcgctccgtatacaacctgtttcatgccgtcgacaaacgaatggaaggtgttgttgatgccgcgtcctcccgcaagaccggcggcaaagccgatgatgagaaagccggccgacagctcgcttaaaaaccatccccattgaaaaacaccgaacatattgatgccgaagcccaatgctgtaatcagcaggacgaggccgtgtcttccggtgaaggaaagatcagcgtgtcctgcggctgtctcttcatttatctctgtttcgcttccatacatcaaaccggtattcgggtgcgctttgacttgttgagcataacgcatgacataaaaaatggagaaaccgagcatggcggcataaacggccagtctataaccgaaggcgctaaacaccgggacttccgcaattgtctgtgcaattccgactgtgaacggattcaacatgccgccggtgaaccctgcagccgcgcctagagaaatcatcgccagccctgtcattgaatcatagccaagcgctctcgcaacagcgattccgatcggaataaaaataatcgtctcttcagacaaaccgatcgttgcgcctccgatggaaaagacgaacatggtgacggggatcaggaggaagccgcgtttcttcaagcgctgcacgagcacatggacaccggcgcgaatcataccggtctgatggatgatgccaaaagctccgcctattaaaaagatataaaaaataatatccgccgattgaatcatgccctccggtatggctttaaacatctcgaaaaaaccgaccggacctgcgtcagtctgcttgtagctcccttgtacgataaccgtttggccgtcttcttcaacccgcttaaattctcctgatggaatgaagtatgaagccagtgcagctaaaatgataatgaaaaaaatcaaagcataagtatgtgggaagtgcagttttgttttctgtggggtgccattgctcattccgttcgtctcctttataatgtattaatattcagataattatatatttaaacattttgaggatatgagctttactttgtcaaccctggaaaaaactttcggtaatcgagaagggagaaccgttatgaaaaaacaaattgagaaagagatcgaaaatattcgtgaagagctgctgcatatcagccagtatataggcaatcatcctgaactggggcacgaagaattcaaagcttcaaagattctgtccgaggagctgaaaaaacacggttttcaggtggaattaggcacatgcggccttgcgacggcgtttacggccgagtttgacagcggccgtcccggtccttccattggatttatggctgaatatgatgcattgcctgaccttggccatgcctgcgggcacaatttgatcggcacgatggcggtcggcgccgcaatcggcgtcagcaaagtgattgcatcgtgcggaggaaaagtgtatgtttacggaactcctgcggaggagacgaaaggcggaaaagtaaccatggccgaacaaggggtttttgatcacttggacgccgctatgatggttcatccgtattgcaggcatgaaaaaagcgggacatcgctggcgatggatgcgatccaattcgaattcttcggaaaggcctcgcatgcggcgggagcacctcacgaaggaatcaatgcgctcgatgccgtcattcagacattcaacggcattaatgcgctcagacagcacattctccctgatgcccggattcacgggattattccggagggagggaaagcggcgaatgttgtgccggattacgcggttgcccagttttacgtcagaggaacggaacgcgcttatgtcaatgaactgctcgataaagtgaaaaattgtgcaaaagcggccgcacttgcgaccggagcccggcttgagagctctttttatgagctgtcttacgatgatttgaaaacaaatgaaacgctgtcagacgcttttacacaaaacatgatcgagttgggcgtcgatccggattcgattcatgaaaaagcggacggaggaggctcggttgatatggggaatgtcagccagatcgcgccttccattcatccttatgtgcaaatttgcgatgagccgtatgcgtgccacacacccgagtttcgtgaggcggccatgagcagccgggggttcgaaggcttgatgctcggcgcaaaatctatggcattcaccgcatatgatgtgctcaccaatgaagagctgctgaaaaaaataaaggaagaattcaaccttttaaaggcgctggcctaaacggatgatccgaaaacgatcaagtcccgttttgatgaatattgacgagaagccgccggggagcccggcggcttcagcgtgtcgacaaaccctcgcattcgttgtcaggcctgcgcgccggtgcctaggaattacaaacattggctgttctagactgcaaggattgcgtttcacgctgaaaagatgacaaaatcccaaaactaacagtcgtctacaggtcgagcgataagcggatcatatcgatgcagcgcatgccgttttcgtatatcggcttctcgtaatgtctcaggaaaaagtcccggtcgatgccggtgattctaaatccgcatttttgatagagcgccagctgaccgatgcttgaattcccggttccgatttcaatcgtcttaaatccttgagctttcgctgtttcaatcgcatgcataaccaattgtctgccgattccttttccctgcagatcttctttgacggcgatattgacgagctctgccgtttcaggcctcgtcggcagcagcacatagacaccggcaatccggcggtcgatttcggctgtatagcactgtccccgtttgaggtaatcgttaaccagtttttcggaagggtctgccgtcaacagcaaatcaagcggcggctcatgttctggatgcaatctccgaatgttcatttcactcatctccttttgatctaaacagaaatcgttgaaatccccaaaaggctcatgcacaatagtaagcacaagcgaacagtaaagtgaggtactgatatgaatatatctgactatgtaaagcatgacgcggttgctttatctaagcttatcaaacatggggaagtaacggtcaacgaattaatcgacgctgctttttcccgtcttgaagaagtcaatccagaactgaatgcagtcattcggacaagaaaagagcaggtcaaaattgaatccaaacagcttgacatcagacaccagccgtttgccggggtgccgattcttttaaaggacatttcccaagcgttgaaaggggagcctctcacagccggcgccaagctgctttcatcttataaaccaaagcgcgattcgaatttcgtcgcgaaattgcgcggcgccggttttttatttctcggacagacgaatacacccgaatacggattaaaaaatatttctgagcctgaattgtatgggccgtcgcgaaatccttggaacactgattattcacccgggggttcaagcggcggttctgcggctgcggtggcggccggaatcgttccacttgcaggggcaagcgacgggggaggctcaatccggataccggcttcctttaccggactattcggtctgaaaccgacccggggcagaacgcctgtaggaccgggcgccggacggcagtggcagggggcatcgatcgattttgtgctgtcccgtacggtcagggacagcgcggcgctcctggatattctgcaaaccattcagcctgaagccgcttttcaaacgcctttatttccaggtcagtatgaagaggatatgaaaaaagggctggagcgccctttgaaaatcgcattctctgtagaatcacccgtcggaacgcctgtcagcgatgaagccaaacaagccgtccgccgcaccgttcgatggctggaagcgcagggacaccatgtcgaagagcagacgaacggcgttgacggaatccggttaatggagaactactacttaatgaacagcggtgaaatttccgcgatgattcttggaatggaaaaaacgcttggaagagcgatcactgttcaggacgttgaaattgtcacatgggtgctgaatgaagcaggcaaaaaagtgtcggcagccgaatttacagcaagccttgcttcctgggatcgagcagctgcacaaatggcggcgtttcatgagacctatgatctgtatgtgaccccggcaacggcttaccccgctccaaaggtcggcgagctcacccataccgaaaaagaagccgaagcgctcctgaaagtgagtgagctggaaaaaatcgagcagcagtcgctgatttatcaaatgtttttgaaaagcttgacatatacaccattcacacagcttgccaacttaaccggacagcctgcaatgagcgtcccggtccatctgacaaatgaaggtttgccgctgggtgttcaagtgacggctccgaaaggaaaggaacattggctgctgcgcaccgcccatttattagagcaatcagacttatggatcggaatgaaaggaaatccaatgctcggcagtctgtaaccgtataagagagaaccgcccgttaatcaggccggtcttcttttttatcgtacagtttttcaagctcgtcaaccaatgttccgacatacgtcacagcccggcggatcggctggtctgtcgacatgtcgacaccggcgtgtttcaacaagtccagcggcttcatggtaccgcctgcttttaaaacgttcagccatctgtctacggcagggcggccttcttctttgatctgttgcgagacgatcgtcgatgctgtcagcccggcagaataggtgtaagggtataaccccatgtaatagtgtggctgacgcatccatgttaagcttgctccttcatcaaccttaactccgctgccccagaattcggagagcacggcgctagtttgctcagacagtacggaagcggtaagtgcgtgcccctgttcggcgagctcatagactctccgctgatattccccctcaagcagatgggtgacgaaattgtggtaatacgtgcccatcagctggttgatgacccagcgcttcattttcggatcatttgttttggaaaacaaatgctgagcgagaagcatttcgttcattgtagaaggcgcttcaatgaaatatagagacggtctgacattcatgatgcgctgctctcggttggcaaagtaaaaatggccggcatgaccgagttcatgggcaagggtaaaggcatcccgcatcgtatccgtccatgtcatcaaaatgaaaggatgcgctccgtacggacttgaacaaaacgcgcccgtagatttgccgatattgtcagcgagatcaacccaccgctcagtcaaggcggtttccatgacttccgtgtactccggccccatcacttgtaaagcgtccaagatcatccggccggcctgttcgtaagtcgtctttggactgaagtcgtgatcgagcggagcctgcaaatcgcagaagcgcatttcgtcgaggtctaatacgcgttttttcaaggcggcatacttgcgcatatgaggtgcaagttcgtttttaatcacatcaagctggttgcggtacatttcgagcgtgacgctttgcggctgaagaagcatatgggtgacggattcatatccgcgcagccttgacatgctgacctgttttttgacctctgtttcatagatggcggcgatggtgtttttgtatgtttgcagggtattggtaaaggagtcgaatgcggttctgcgaatatgcgtatcaggagagaacatgtattttccttcatataacgcgaacgaattggcgagtgtattgccgtttcggtcctgaatcggggaaaattgcatatccgcaagcttcgccatcccgaaaattttgtacggggcatcatgtatttcgcctaaaacggctagcgcttcctctgtttcgggagcaagtttatacggcttgagttccattatctccgtcagcattttgctgaaaggctccagtcctttctcgttttttatgtacgtctccacttgattttcggggaattcaagaatttccgattggataaatgaaagcccggcgtttatttttgcttgcagcgcggccatccttgaagcatcagcttggttgacggggtttgtcaaatcttcggactttctgaggtgagtataggcggcggcccggactaggcgcttcagcagtatctcccgcagcgataaacaatccagcaatacgccggctccttcatgcagccttcctttaaatgagccgatggatgcgagatcttcctcaattttcacaagtgcgtcttcccaagcttcataagaagaaaataaatcagtaagattccaagtcagttcctccggcacctcacagcgctttggtcttttttctgccactttttccaatgtgcagcctccccttgaaaatatttcgtgtttctaattaattatataaaagacggcagcataatgaaataaaaaacgacggcttctaaagaaaccgtcgcaaaccgtctgcttattgagcattgcgatttcgaccgcccatgcttctcatgacgaggctgacgatgaagatcaaaatgatcgccccgatcaaggccggtatgatattaaacccgccgaccaccggaccccagcgccccaaaatcatcgagccgagccatgaaccgataaatcccgcaataatatttccaatgattcctccgggtacatcacgtctgataatgaggccggccagccagcccaaaattccgccaatgatcaatgaccaaataaaaccaaacattgaacagtacctccttgttttttagacattttaagccttatacctatcttttggaattcgtgaataaatatacaaattttttctaaatgaaaccatttgggcgaacaaacgtatgaaatacggacaccatgaaccgtcataagactcttaaatcaagtgaggagagtaagatgaaacagtcattaaaggcattaaaaggctttcgggcattcgccgaagaaaaaatgaaagagtggaacgttcctggagccgcggttgcagtcattaaggaagacgagatcatcatggcggaagggtttggattcagggataaagaacggaaattaaaggtcaacccggaaacggtatttgcgatcggttccgcctccaaggcatttacaacggcggcgatggcggtattggctgatgaagggaaaatggagtgggataagccggtaagggaatatctccctgagtttaagatgcacgatccggtagcaactgaacggatgactccccgtgatctggcgtgccatcgttctggtctcccaagacacgaaatgatgtggtacaattcctccttttcaagggaggagcttttcagacggatccgctaccttgagccgaatcaggattttcgatcaaagtggcagtatcagaacctgatgtatatgacggctggttatcttgctggaagaatagcggggacgacatgggaggatcttgttcatgagcggcttttcaaacctttgcatatgacatccagcagcttttcggtcgaagatatgcaaaagctttccgattttgcctttccatatcaagagaacaacggaacggttgaaaaaataccttttcgtaatatcgatgcgatcgggccggctgggtcgattaattccaatgccgtggatatggcaaattggctgcttcttcagcttggcagcgagaaattcaacggggttttatcagatggaagccttcatgaactgcatacgccttgcatttcctgcgactccattattaaagcgaaggagcttccggtctgcagctatggactcggctggtttgtggaaccgtaccgcggtcgccatatgattcatcatggcggaaatatcgacggcttttcatcgcttgtcgctttcatgccttatgaaaagatcggcattgtcattttgacaaatatgaacggcagctttcttccaaatgttctggcgtacaacatttttgaccgcttgcttggattggaagagatcgattggagcggccggctgaaaggcgaagcggaaaaaataatgaaagccgctttaggagtggatcgaaccgcggatcttaccaaaattgaaggaacgaatccttctcatgccctgaaggactacacaggtgtatatgagcatcccggctacggcgaaatcaaaatagagcttaaagacggcgtgttacaggcgctcttcaattcgtttgtgatgcctttgaagcattatcattacaatatattcgagatgaaaatgccgctcacggagatggcgatgctcgcatcattcgacaccgatatacacggacatatcagccgcctttccataccgtttgaaatggcggaaggcgctagagaaatcgaatttgtcaggaagccggttcagcaattgtacgaccctgaatttcttgcttctttaacagggaagtatgcattggaagacggaacagatgtcgttgtgtctctcagaaacaaccggacgctctgggtttcattgcccggtcagcgtgattacgaacttgaaccttaccgtgagttgacatttcaaataaaaaatctgccgggattcagcgtccgatttgaagccggcgattccggacaggtaacaggtttgcgcttcatccagccgaatggagaatttcctgctgtccggaaatagcagcaaaggacatatttcgatttatttcccgagaaatatacaggtgtgagccagtctggtcacttctggacggcttccagtaataaatccgccagatgaacggctctcactcggtctgtaagtcctgctcgttcaatgccgagcttcatttgcagcagacatccgggattagccgtaacgatcgtagcggcccgggtcgctgctgctgcttccattttagtatcgagaattttcatcgacatttcggattcgacaatgttataaatgccggctgatccacagcagctttcggcatttttcatttccttgaattcaatgcccttgatgctgcgaataaggcgtctcggctcagcggacgttttcatgacatttcgcaaatggcacgaatcttggtatgtaacgatttgctccggcagttcaagggattgctgatcgaagttcagttccaacaagacggaagaaaagtctttcaattttcctgtgaaagatgctgcccgttcccgccattcggagtcatctttcaggagatgatcatattcctttaaaaaagctccgcatccgcctgcatttgttatgataaagtccgcgtttgaatcctcgaatgcctgaatatttcgttttgcgagcaggatggcctcagacttttcgccgctgtgtccgtggagggcgccgcagcaggtctgctgttcgggaattatgatctcgcagccagccagccgcagcagctcaatggttgccatattcgtatccaaaaacagcgtatccatgagacagcctgagaaaaaggcggcccgtttttttctctccccgatcgcagggagcaggtgcggccgttttttcagctgtttcatattaggaaccttcggcaaaaccgcctccatcttcgcgaggtggtccggcaaaagccggagcaagccggatttgcgaatcacgttttgcatgccggaacgctgatacaagccgagcattccggtcagcgccctgattctgtttggatgggggaaaagccctttgaatactgcgcggcgaagcactttaaccggaaaggcgtgctttttgttctgctgaataatatctctcgcttcttcaagcaagcgtccgtagtttacgcctgacggacaaacaggttcacacgcgcggcagccgaggcaaagctcgagtgaccgttcgacatcctcatcaggctcgatcgtcccatcgacgaccgctttcatgagcgcgatgcgtccgcgcggagaatggctttcttgaaaaccggattcgatgtaggtggggcatgacggcagacagaagccgcagcgcatgcaattcagcagctcttcctcatccattctttgtttaaactgctgttcaatgacctttctttcgtcagctgtcgtcatcttgtcaccaccactcgcttgcgggagtctttcgcaaatatcttcccgggattcatgatgttgtttggatccaatgcctgttttaccgccttcatggcggcgattcccgcattgcccagcttcagttccaaatagggggctttcatttcgccgaccccatgttctccggtaattgttcctcccagttcaaccgcttttttaaagatgtcttcaaaagcctgttcgacccgtttcatttcttcactgtttctgacatctgtcgtacaggtcggatgaaggttgccgtcgcctgcgtgcccgaatgtacaaatcgatatttggtgcttttcggcgatcgaattaatcgcttttaccatttcagcaatttcagaacgcggtaccgtagcatcctccagaatggtcgtcggctttaatcgcgctaaagccgaaagggcggtgcggcgggcctcccgaagattttccgcttcagcttctgtttgcgcagtttgaacggacacagcatttccttttttgcaaatctcttcaatcacggcgatatcacggcgaactgcatcttcggtgccgtcctgttcgatcaggagaaccgctttggcatggacgggaaggccgattttcgcgaagtcttcgatcacctgaatcgtaggttggtcgagaaattcgagtgtcgtcggaatgattttatgtgcaatgatatttgaaacagtttgtgctgcagagtcgatatcttgatagagagcgaggacgcttttttttgtttcgggtgccgggatgagttttaatgttgcttcagtgatgacgccgagcgttccttcagaaccgacgaacagacgcgtcaaatcatagccggcaacatctttggccagcttgccgccggtgcggatgatgtccccgtttgcaagaacgatttccagcgccatgacataatcgcgggtcactccgtatttcaagccgcggaggccgcctgagttttcgttaatattcccgccgattgtcgagatcttcattgagctcggatcgggcggataaaataatcctttttcttcagcggcgtgaattaagtcaagtgtgatcacaccgggctggacggttatcgttaaattttcttcatcgatttctaaaatttgattcatatgcttaaacaggaggacaatccccccttcagtcgggcatgtgccggcacataggtttgtacctgaacctctcggcacaatcggaatgcggtgcgtgttgcagattttcacgattcgcgatacttcttccttgctgcgcggggcaatgaccgcgtcaggcatcgattgaaactgtggtgtcgcatcataggaatagacgagccgtccggcgttcgaatcgtcataattggcagagccgacaatctcaatcagcttggatctcacttgtgaggaaatcatgtatgatcacatcctttaccaattattatacaaaatcaaacgctttcaaaaaatcattcttttaaacttcaaatataaaaaagaacccgttttcaaaggaaacgaggttctttgcggaaagcatcaggttgcaaggctgattgcttgattaagcacttttgccccgtccatcattccataagccatttggtcaatgacggccacgggtgtatgatacggcttggcacgctctgtcatttgcccttttaaataccggacctgcggaccaatcagtatcacatcaatttcatccagatcgcttggcaaatctgcctcagcatacgcattaatttccgccttcaatgaacggttttccgcttcttcccgcattttttttatcaatatactcgtagacattccggctgaacatacaagtgcgatcttcatttttctcttcctttcccaagctcttgatataaatcaatcatttctttcgccaaatcttttacagttatggctgtcattaaatggtcctgagcatggattaataatagattgggtgaaaggcctgcgccctgtgcttctttttgcaggaggcgggtttgtgcctgatgcgcttggttcagctccgattctgcttcttgtatcttttgataaccggtttcgcattcgtgatgtttcacaagctgcaacgcttccattgcagaagaacgcgcatttccggcgtgaaggatgatttcaaatgagacctgttccaattgaagtgtatctgccataacattcactccttatttattcattttctgtctggtgcaaggcggaacgttgagccgcttttataaacgggaggtagagcagggtggccagcaccaggttgaagatttgcaaaaagacccctcggactgatcctccggtgacaagatatccgctgacaatcggaggcgtcgtccacggaaggatcgccacagttttcgggacgagaccggaagccaaagcgatatatgatgtaatcgtcaaaattaatggaatcaagataaacggaatgaacatgatcgggtttaatacaataggaaggccgaacagaacgggttcattgatattaaaaaggtcgggtgcgagagacacctttcctatcgttttgtagtgcttcgatttcacggcaattaaaatggcggcaagcagagccaatgttgttcccgatccccccataaatacgtaagaatcgaagaaaggctttgtcacaatatacggcacttcaaaagcgctcattccttgcgagaataagtgctgattttcctgaatgagcgggaggtagacggattccatgatcggcccgaggatgtttgttccatgcaacccaaagaaccagagcaaatgattcaagaaagtaaaaatcaaggctgacccaaccgtgttggaaaggccttgaagcggctcttgaatcgtgctgaaaacaagctcatggatgctttgccccgaaaagtgaacgatcagagcgttacatagcccggcagtggataagatgacggcagccggcaatagagcattcaaggattttgtgacgccgtcaggcactccttcaggcattttgattttcaatttctcatttttggaaaacagccggaagacttctgtcgacagcaaagccacgattaagccgacgaacagaccttgggctcccagccaagtcattgagaagccaaagtcttcagtggtcggtgtaagcacggcgaatgcgccaaccccgattaatgcggcagacagaccatctgtgtgatatgactcggccagcttgaagctgacagccgcaacggctaaaaggctcaacagagcaaaagagccattccatatcgctccgccgacagccgtccatccctcgccgaaaagaccggtcataaagttttgaaacgccggtattggaaaattattgaccaggatggcgagggaaccgatgatgataagaggcataatggcgatgaatccgtcgcgtattgcaatcaggtgcctttgggaaccgatccttccggcgatcggcatgatgtttgattcgatgaatgccatcattttattttgtttcatgtgcacggacctcctcaaaaaattgcgggagataacgtttatgagcctcgagcatttcatcgagcaccttttgagctttgtgatcagaagagaccaatggattggtggtcatggctaagtatgccgtatcgtagtcgccggtgaccgcagcttcaatcactaattgttcaaattttttcatcaagatgatcggcccgctgatggcatcgggcagttttccgacggtcaggggaatcggtccgctttttgtaatgacactgttgacttcgatcaccgcatcatctggaaggtctggtatgcttcctttattcagtgtgttcacggtctgaatatccattgaatgatgataaagcgagttcattaatgagcaggctgattcactatagtaagctccgccgcggctttccagttctttaggcttttcatggatcttggcgtctttgtatctctcaaacagctgccgctccacttccatgacggtttctgcgcgcgtccctttgttattgtacgcttcgatatcttttgcgagcgcatcttcatgttgataatagtactgatgataagggctcggaagcattcgcaaagaccgcaaaaattggcgattccacggcagcgccgcaatattggaaggcgagtagccgaagtgatcattcaacagaagctcaatcgtctcttctgtccggtcgatcccgtcgatccaaactctttttccgaaaacaaaatgattgatgcccgcgaattcaatcatgacgaggtttacatccacgccgaaaatttctgcgatgctatttttcatgttgtaaggaatattgcataccccgacgaccttttgatgaggtccgtgcttcagcaaagcttccgtcacgatgcccgccggattggtaaagttaatcggccatgcttcgggacaaatctcatgaatatcgcgggcgatatccagcataaagggaattgtgcgcaaagctttaaacatgccgcccgccccgtttgtttcctggccgatcaggccctggctgagcggaattttttcgtctaaagctctcgccttcagtccgccgactctgatttgaaccgttacgaaatcggcgcctttcaatgcttttgcccgatctattgtatggctcagttcgatgggaacccccgcatgtctgatcattcgcttcgcgagttctgagacgatgcgaagcttttctttgccctcctcgatatcaaccagtacaatctcattcactggaaattgatgatgccgtttgatgatgccttcaatgatttctggtgtgtagctggaacctccgcctataacaactactttcagcgccataatccccctccttaactctcttttatgaaagcgcttcacacaattgaaacttaacatgttataacaaatttgtccatacatatttgttataacaaattgtttttttggggaactttttgtgttattctataattacgaactcaccccaaaggagaaaatgtatggcgaaacaaccacagctccacagtcgaattaaacaagatattgtagataagattgaaagcggttattatccgccgggcagcctgttgccgacggagtccgagttttgcaaaatttatgatgtcagccggacgacgctgcggaccgcgctgaatcatttgcttatggaaggggctatttaccgaaagcagggaaaagggacatttgtcgccaaaggaaaagtaaagcagatcttaagctccagcagcctccgctatgcagaacaattgaaggctcaaggctttaaaccgaaaatcaaggttgttgatttgcaaaaaataaagccgtccgaaaaactccaaacccgtctcggaatcgacgctgaacaaatggtctatcaagtaaaaagaatccgctatgcagacgatgaagaaatccagtttgaaacagcctatatcagaacggatctcgtacccgaagtaacggaagaaatggcgaatatctcactttaccagtgcatcagcaggcagggaaacaacattaaaagaacagaggagcaaatcaagattgtgatttctgatgaggagattgcacaccatttaaatattacacaaggcacgccttgcttccagatatcgacgcaaacatttttggcgtctgaagaggttgtcgagtattctatggcctattttcgcggtgaccgcgttgagttcttcattgaacgcgattatggacaaagggggaaatgaaagcgtgaaatctctaatcataaatgcagatgattttggattttcaaggggagtcaaccttggcattattgaagctttccagcacggggtcctcacatcgactaccctcatggtcaatatgcaagaagcggatcatgccgtcgaactcgcacggcaaaatccagaactcggagtcgggatccacttgacattgacggccgggcgtccgattcttggcggactgcatacgataacagatgaagaagggaattttcgcaagcttttgtattaccaaggttttttcgacattgatcttgaggaagtatatcgagagtggaaagcgcaaatagagaaggctttgtcctgcggtttaaatccgacacatatcgacagccatcatcatattcatacatacggaaatctccctgaggtgtttgtagaggttgcgaaagagtatgatctgccttgcagaaaggtcaatcatgaccatccttcactgtggaagggtgtaaggtcgaacgatgcttttgagctgaaagtcgaccgattgaaggatctatcgagcttctttaatgattatcaagacgcagctgtgattgaagtgatgtgccatccggcttatgtcgataaatgtctgcttgaaaaatcgtccttccattatcctcgggcatatgaactttcactgctgacggaaccttctctcaaagccgctttacaacactgtccggatattcgcctcacgtcttacgccggtctatgaaagagatgccgcttctattccttggcttaataagatgtgaaatggggtagaaagcggcggttgttttattcaattacttcatgttgacagttcggaaaattctgattaatataaatttgtcataacaaatttatgcattcttcacccattggaaagtcttcttttacacttaaatgtatagacgtctatacgtgtttcaccctctgcagaaccagcttttcaaacgccaaaattttaatgaaaccatgctgtcgatctcacttttgtaagcgttttcccttgttgtcttcaatgtatctgctgctattagatgacaaggaaaaatataaaaccagcaaaaaaggcggtgaggaaaaagagagttctagtttcatagcttgccaaaaaattgcttgtaaaggagatgaaaatcgtgttgatcaacaaaagcaaaaagtttttcgttttttctttcatttttgttatgatgctgagcctctcatttgtgaatggggaagttgcaaaagccgattccggaaaaaactataaaatcatcggctactatccatcatggggtgcttatggaagggattttcaagtttgggatatggacgtttcgaaagtcagccacattaattatgcctttgctgatatttgctgggagggaaggcatggaaaccctgatccgacaggccccaatcctcaaacgtggtcatgccaggatgaaaacggagtgatcgacgcgccaaatggaacaatcgtgatgggcgatccctggattgacgcacaaaagtcaaatcccggggatgtctgggatgaaccgatccgcggcaactttaaacaattgttgaagctgaaaaagagccaccctcatttgaaaacgttcatatcggtcggggggtggacttggtctaaccgcttttcagatgtcgcggcagatcctgcggcaagggagaatttcgccgcttcggccgttgagtttttaaggaaatacgggtttgacggggtcgatcttgactgggaatatccggtcagcggaggattgccggggaacagcacacgtccggaagataaaagaaactacacgctgctcctgcaagaggtgcgcaaaaaacttgacgctgcagaagcaaaagacggcaaggaatacttgctgacgatcgcatccggcgcaagtcccgattatgtaagcaacactgagctcgataaaatcgctcaaaccgtggattggattaacattatgacctatgactttaatggcggatggcaaagcataagcgcccataatgcaccgctgttctatgatccaaaagcgaaagaagcaggcgttccaaacgctgagacctacaatattgaaaacactgtgaaacgctacaaggaagccggtgtcaagggtgacaaattagtgcttggaacaccgttctacggaaggggctggagcggttgtgaaccaggggggcacggagaatatcagaaatgcggaccggctaaagaagggacatgggaaaagggcgtattcgatttttcagatcttgaaaggaactatgtgaatcaaaacggctataaaaggtattggaacgatcaagcaaaagtgccgtttttgtataatgcggaaaatggcaatttcatcacttatgatgatgaacaatcattcggccacaaaacggattttattaaagcaaacggattaagcggagcaatgttctgggatttcagcggcgattccaatcggacgcttctcaataaattggcagccgatttagattttgcaccggacggaggcaatccggagccgccttcatcggcacctgtgaatgtgcgtgtaaccggaaaaactgctacaagtgtcagcctggcgtgggatgcgccgagcagcggagcaaacattgcggaatatgtcgtgtcatttgaaaaccggtcgatatctgtaaaagaaacatcagcggaaataggcggcttgaagccgggtacggcctactcatttactgtttcagcaaaggatgcggatggaaagctccatgccggaccaacggtagaggtcacgacgaattctgaccaagcctgttcatatgacgaatggaaagagacgagcgcatacacaggcggagagcgggttgcatttaacggaaaagtgtatgaagcgaaatggtggacgaaaggcgaccggcctgatcaatccggtgaatggggcgtatggcggctgatcggaggctgcgaataagagaaagtcaaatggatagaaaacgataaagagagatttggggaacagcttctcacgtctctctttatggacaaaggagtctgagtaaacatgaagaaagccgcttcatcttttttatcttgtatgctgctcctcgcgctttttatcccgaaccggcagatttccgcagagacttcaagcgaaagaccggactgccgtccggaagggctatgggactcgggcgttgaacatgtgccgtattgcgatgtatacgacaaggacggccgtgaaaagctggccaatcagttagaccggagaatcatcggttactttacgagctggcgtacgggaaaaggaaatcaagatcgttatttagtaagcgatatcccctggaagtacttgagccacattaattatgcgtttgcccacatcggggaagatcatcggatttcagtcggagaagaggcagatgagaacaacccgtccatcgggatgacttggccggagcatcccgatgtaaaaatggatcaaaccttgccgtataaggggcattttaaccttatccatcaatataaagatagatacccggatgtgaaggttttggccgctgtcggcggttgggccgaaaccggcggctatgtcgacaaggacggaaagcgaattccaagcggcggcttttactcgatgacaacgaatggagatggatctgtaaaccacaagggtattcacacctttgcggaatcggtcgttgcgtttctcagaaaatatgagatcgatggaatcgatattgactatgagtaccctacatcgatgcaggatgcagggaatccggcagattggaacatcgccaatccgcggcgcaacgggttaaataaaagctttgaggcattgatgaaaacattaagagaaaagcttgatcaagcgtccgctgaagatggaaagtactacatgctgaccattgcagcaccatcctcggcatatttactgagggggatggaaacgtttaagccgcttcgatatgtcgattatgtcaatatcatgtcctacgatcttcatggagcctggaatgagtttgtcggaccgaacgcttctttattcgataacggcgaagatgccgaactcaagcagtccaacatttatactacgccggaatacgaagggatcggatatttaaatacggactgggcttaccattattttagaggggcagtagaatcgggacgaatcaatatcggtgtgccttattatacgagaggctggaaaaatgtgaccggcggagcaaatgggctgtggggaagagccaaaagcgcagattgccctcagggactcaggcaatgcggtgacggagcaaccggaatcgataatatttggcacgataaagatgagcaggggaatgaaattggagcaggggcaaacccgatgtggcacgccaaaaaccttgaaaagggcattgctggttcttatctggaaaggtatggattgagcaaggctgatttgacaggcgtttataaaaggcattatgacgcagggctggcagcgccttggctttggaatccagaaaagaaagtatttctatcgacagaggatgaggaatcgatcaaaacgaaggcggattatgtcattgataaaggaatcgggggtgtcatgttttgggatttgagcggtgattatgactggtatcccgaacgaaacggcagtaaaggagaatacggtatcggcaataccttaacgagaacgatgtatcataaattctcggatacaacaccatacgataatcgactcagcacatcacctttgcctgatgaatcactagatgcagaagtagagttgacgaactttccgttaggagatcaaaattacccgatccacccggtgatgaagctgatcaacaacagcgatgtcacgattacgggaggttcttttatcgaatttgatgcgccgacatccacttcccctcggtttagaagctggagcggcgatcatgttgaagtgatttctaaagggcatacgggaccgaacattggcggactgacaggagatttccaccgcatcagagtgactctatcaatctggaaaaccattaaacctggtgaggaagcggagtttcagcttgtctattatttgccgatcagcggtccttcaaatttcacgatatcaatagatggcaaaaagtacaggcttaaaggaaattaagtatacggccgttagatgtgacagcccgttccaaaaggaagcgggctgtcttcgtgtattattgtgcgctgtttttccagttggtcaaattgtcgaacacctcttttgtaatccgggtgcctctgttgtacgaggagccgccgtatactccatttgtgtgtacggcaagcgagcacggaccgctgcagttcgttctggagctgctttgttcgaataccggtgaaccgctttgtcctccgtacgtgtccattgcgtactgcaatttatacgtttcggagatggcaatcggtcctgaatgctgccattgtgtgcctgctgttttatcgcctgggtagccgctgatggtaacagttgtcccaacaagtgatgaagtagtgtacgagtatccgaagtatccgacagtattgccgatcggttcgcttagttcgattgcgccgtaatcgtaattggtgtttccgcttctccatcctgacggaataaagtagcgcgtcgatttaactgagccgtaaggatagcttgtcccgttccgtcccggcgaaacagtggctgtaccggcaaatgaaccgcttgatgtgtcatagatgcagtgtccggctgttgcgacggttttcggaccgatcatccatccggtgcatgaaccgatgctgcttgaaatatgaacgatcgctctgtacggatatgcggttgtgttggtgacccttgtccgatcatcagaaccaatcaccgatttaatgctgtaaggagctttggcgggtgactttttttccgctttttcctttgtttcattcactttgccggtgcctgtaaacgcttttgaatacaagccgtattgatcgctcttaatgtttgggtcataagtaaccgatgtttccgctttgtatgaaggatcgcttgaaacaggagtatgaggcgatggcgcggcttgggccgggtgcatacctaaagaataaatagaaataccaatgagacctgtgatcaaacctcgtttaacactctttttactaaccaaatcatatcacttccttattttgttgtaagtacaagttagatattaacaaaataattctgaattttccatatgtttaaaaaagatcatactaaaggtgtgtattaacattttgtttgatcatattgataccgggtaatgtacatggagaaaagaaattgaggggtgtttaggttgtatagtgatttaaaaggaaaaacagcaattgtgaccggctcttcaaaaggtataggcaaggcggttgcagaacggtttggaaaagaaaagatgaatgtggttgtcaattatcacagcgatcccggaggcgcacgggaagccgtcgacaatattcaagcagcgggcggaaacgcccttgcgatagaagctgacgtgtcttccgaagaggacgtgaaaaagctgattaattcagcagttgaacactttggttcacttgatgttatggtcaataattcaggatttaacggcgcgggcgcctttccgcacgaacttgagcttgatgagtggcagaaagtgatcgacgttaatttaaccggtgcgtttctctgcgcacgcgaagccttaaaatatatggcggaccgccgcatgaaaggaagcatactcaatatatccagcgttcatcagcaaattccgagaccgaaaaatgttcactactccgcttcaaaaggcggaatgaagctgttaacagaaacgcttgccctagactatgcggacaaaggaatccgcgtcaatgcgattgcgccgggaacgattgcgaccgaaagcaatgaagacttggagggaagccgcaagtcggaacagctgaaaaagatacccatgaacgaatttggcgagcctgaacaagtggcttccgcagcggcatggcttgtgtcgcaagaagccgcctatgtaacgggcgcgactttattcgttgacggcggcatgacgctgtatccatcacagctggaatagcaaaggccgttttttcagctcccgttctgccctttattgaatggcggaatgggggcttttttaattgtgttaccttttattttatagtaaaagaaacgagtttaatatataccgtgcatcgcgctgatcaggttgctattacaactttcaataaaaggagattatgatgcaaaacaatatcgttcacattgccttcggcgagtctgccggcggcagtataaacatgatgctcaaacagtcgggaggaacccatgaaaagagtctgatcgttctgcctgaattattttccatcggaccgcttcaaaagctggaagccaaagaaggcagggtcaatcgttatgaatggttgaaaacatatctgaatgaccgatttcacgagtctggaaagagatacagccgttttgaagtggcggtttctgcattgtccggcattcctgagcaagcctctgtctttatatggacaggagatcatgcacacgaacagactggtctgaggtttgtacaccatatcctccgacaaatgaacctggctgttttccatttgaatacgacgaagttcttcccccatacccggagttctggtgaattgaatgatgaaaacctgagattcatttatgaacaaggggatcaggcggctgtgacagccgctgaaggacggcgccttgctgaggaatggacagcgctgtctcagcagacaagcgtgttgcgggtatgggaagacggtagaatcaaaagcgtgaaggaggatttttttgattcgttcataatcgaaaaactggctcagcttcaaaaaaaccgttcagccaacacctttatcaactgtccacgcttgatcggcgaagtcattggccatctggaggagaacatcggagatgaatttatcgagtaccgcattttagagctgatccgcaaaggtatttttgagatgaaaggcacaacaaaaggaatgagatattttaatgtcaggttaaaaaatgtcatgtaagttcaccagttaaatccaattatctcaattttcatgaaacgattgatagtatatttcgtatacataaggagaagaaaatgaaagagaggtagacaggatttggttcgtgaacagttaaaacaaaaagcgcaatccatcagtaaggttcccccacattatcagctcatgatcgaagattacggagagaagtacgaaaaagagaggcgggtttttttcgcttggcaggacattgaagagccggagcgggacatatcggtggagttagatcatcaaggccgcttaatcagtttgacaaaagagtatgaaccggtggtcgaggaagctcttcctgatgaaaggctgctgcaaatcgcccttcagtttacagaacagcattacccgaatgcgccttatgaatttgttttccatgaaaagaaggtaacagaacaattcgttcgttttacgtatgttcagactgtccttgatcttccgctgccgcagacgggcttttatgtccgggtcgccaagaacggagaggtgattgagtttcgctataacggcgggacgagctctttctccattccaaagcagatagctgataagcaatcggtaacagccgattatcttgaacatgttcaattcgaattggcggttgaaaaaatccgcagtgaactttatgaagggggagatgatctcccgcatcttatttacgaagcagacttgccgtttttcagctatcccgccgatatcacggaaaaacgccagatgaagcctgcggctgatgacgaggaagaagaagacacattgccgctccctgtgctgcctgaggctgaccgtcatgctgatatcgatgacatgatcggctttaccccttcgatgcgaaaaatccgcgaaaccgatttgggagagtcaattggaacagtgtggcgcctgggagacgaccctgagccgagagatcggagtatagccggctactttgaaacatggaaccaaaatacgttgaaaatcgtgaaagacaaaaactcggggaagctcaaaggaatcgcttcttttatcaaatcggaaggaccccctgtcttgagcggggaagactgcttgaaacgggcgctgcaatttttgtacaggctttatcccgacgctgatcggctttttcgaatgcatccggcggaaaatgacggggacaggtcaaacgcattttttcaatttgatcttcaatacaaaggggtgccgttaaggcttggctctgccaatatcagcatcaatcggacaaccggcagggtcgtcggttatcacggcccggaaatcgagccggaaacgctgatcgatctgagtccttcgccatccatttcagaggaggaagcgaaagccgtttttgcagcggcatttgatgtgaagctgcagtgggaaagggactacagtcgggaaaaggatgacttctacaggcttgtctaccggccggtatacccttactttatcgatgcccatgacggaaaggcgtttatgagcaaaaacatataataaacggcggctggctggggtggaaaagcccccggccgccgcctcttgtaagatcaaatatcgtcctcggctccagtggagatcggatggtctgggtagctgatccaatcgctccagctgccggcatacagcttcacattttcaaatccggcttcttttaagccgagtacattcgggcaggctgatacgcccgatccgcaatagacgacgatttcactgcccgggtccaaagcagcgtaatgctgtctgagctgttctttgcttttccataatccgccttcggttagattgcctttccaaaaaaagtttttagcgccgggaatatggccggcccgatgatcgagaggctcggtttccccggtgtatcttgaaggatcgcgcgcatcgatcagaatggagccttctctgccaattcgcttcagtacttctttggcatcgagcagttcgttttctctgagcgccggcttaaattcgcgctcgctaggacgaggatcctcggcgttcacctcgtagcccgctttgatccagttggacagtcccccatccatgatatagacgctgtcatgcccgagatagtgaagctgccaccaaaagcgcgctgcaaacatgccgccgctgtcatcataaacaacgacatctgtttgccggtcaatgccgatttttccaagcttcgcggccagaaggtcagggtcttgaagcgggtgtctgccgccgtgctcttccgggttgcgcgacagatcttcttttaaatcaatgaaaacggctccgggcacatggcctttcgtatacgcttttcggccttcgtccggttttgtcaaatgaaacctcacgtcgacaataactgtttggtccgttttttccattaatcgtttgtatacccattcagggctttttaatactgacaattcacgatccctccgttcccctttgttttttctcgggttctgataatagaagaatagctttctttcatgggcaatatcaaagataaatcccgaaatcgtcatcacctaaatgaaacagaatatgataaaggtgacgacatcatgggggtgactaaaaatggcagtcgttcaggcttcttctaaagatatcagtcttttggcaagacttttgagagcggaggctgaaggcgagggcgtgcaaggtatgcttatggtcggaaatgtcggaatcaatcgcatcagggcaaactgttccgactttgtgggacttcgcaccattccgcaaatgatccatcagccgcatgcctttgaagccgtgacgcacggttatttctatcaaagggcgcgggaaagcgaaaggcgtttggcacgcagggcggtcaacggggagcggctttggccggcaaagttcagtttgtggtatttcagaccggcgggggcgtgtcccgcacagtggtacaatcagccgcatgtcggccgctttaaatcgcattgtttttacgagccgacagcggaagagtgtgagaatgtctataatacgttctaacaaaaacatcccttttcaacggtttttgaaaagggatgtttttcgttcaaaataattctgccagtctttcgtaagactgcttcttatcttcaaaccggtagacgttagttaaaatcataaactcatctgtttgatatcgttcagaaagctcgagcagttttcttttgactgtttgaggagacccgatcaccatacggctgcggttttgggcaagcttctttttatcggcagctgtgtaagcggccgatttcgcctcttcaatgcttgggacaaggctgtccagccctttttcaacccggagaagccataaatcttggctcaagcagagctcctcggctttttcatcggactccgcacaaacgacgaaaacggcggccaatgattgggggcgtttaaagaaaggggaaggccgaaagctttcacggtatgattgaaaggcgttctttcctctcgcgggagagatgaaatggccgaatacgtatcccgctcccatgctaccggccaattttgcgctgttttctcccaggcctaaaagccacacctccgggggcgaatccgtcaaaggggaggctttaattccgaagtaatcatgtccggaaggcacggaatcagtcagaaagctaaccaagtcttgtaactgtctcgggaattcgtgcaggcttttatgaaccccgtctgtcagcgccagcctcgttttagttgtgcctcccggagagcggccgatccccaggtcaattctcccgggataaagggcttcaagctgccgaaagttttcagccactttaaagggactgtattggggcagcagaacgccgcccgaaccgacgcgaatattcgccgtctttgccgcaatgtgtgcgatcatgatttctggagcggtgctggcaagcccccgtgtgctgtgatgctcggcaaaccaataccttttgtacccccattgatccgcaagttccgccagctctgcagaatgctttagagctgaatgcgcatccgagccttttgatataggaacctggtcaagaatgctgagctgcatcaattgtcaccggccttcctttcgttttcttgttcagtaagacaagcatatgaaaaacagcagatagggtcaaatcgaagagaatacgagagacaaaacatgattagtcaaaacatgacaccgttgaaacaaaaacgaaatataaatgtaatataaattggcgcctattgtcgaaaatagatggtataataacgtctgtacattagaaacggatatataaatcataggtcataagattcattttttaataatgttcaatcgaatttacataatgaaaaaacaagaatacataaaggaaagaggagtagaaagtgaagaaaaaggtttatacttttggtttagcgtcgattctcggaacagctagtctatttaccccctttatgaacaacacggcatcggcagaaacatctcagcaaaaacaagaaattcagcaaaagcgttctgaagtgaattcaggcatcgagagcaagcggaaagaaatcgccaagctgcaagacgagcagaaaaagcttgaaggtaaaatccaagagcttgataaaaaagcacttgaaacaagcaacaaaatcgaagacaaagaaaaagaaaacaaaaaaacgaaaaaagaagtggaagctctgaaaaaagaaatcaaagaaaccgaaaaacggattgaagagcgttcaaaagtgattaaaaatcgcgtgcgcagcctgcaggaaaacggcggatcccaaaactatttgaatgtccttctgggcgcacaaagcttcggagattttatcactcgtgcaactgctgtttcaacaattgttgatgcggacaaagacctgcttgacgagcaggagaaagataaaaacaagcttgaaaaagcaatgtctgatttaaatacaaaactggacgaaatccaaaaaacactagccgatttaaaaacgcttaaatcggatcttgataaacagctgaaagaacaggcaaacctttctaagcagctgcaaacgaagcaagcggcagcagaatcagagctgagcgatctgaaaaaagaagcgggctctctgacaaaagaagaagccgctcttgaacaaaagcttaaagaagaaagagctgcggcggctgcagcagcaaaagcgaaagaagaatctgcgacggctgaaaagtctgattcaggatcttcatcaagctcaaattcaggttcagtcagcaaatctgacggatcgtccaacagcggttcttcaagcagcaagaaaagcagcagcccgtcaagaaactactcttccggttctgttgtaagcagcaatggaaacgcgattgaagctgccatcagcacaggttcaagcattgtcggcagatctccgtacaaatggggaggcggacgttcacaagctgatatcgacaaccgccgcttcgactgctcatcattcgtacgctgggcttatgcatcagcaggcgtagagcttggattcggtgcgacaacaagcacgcttgtcggcaagggacgagctgtcagcgcgtctgaaatgaagcgcggagacttggtcttctttgacacatacaaaacgaacggccacgtgggcatttatcttggcaatggcacattcctgaacgataacagctcacgcggggtatccgtcgattctatgagcaacccgtactggaagaaagctttcaacggagttgtaagacgggtcgttgaataaaatattatactgagacaaacgccgttcccgattgggagcggcgtttttattttacagcggcaagtcgcgctttttaaaaatgagaatgctgagtgcgaaggcggcaaaaccgactgcggcgagaacaagagacacttgagcgatgtcggtgcttccgttcacaatatcgcccggtctgaataaagagaaaaccgacaggctcctcagccattctgttttttcgcttaatttgcctagcaagtcgaagctgaagaataagaacgtgatgcctccggaaagtccgagggctcttttttcatcatttgaaatggccgaaaagaggaacgaaatgccgccgactgcaaagaagagcagaaagccaagcaggttcagaacgaggaaccttgacacattaaaatcgtaatcaccgcccagcatcaaatggtagccggccagtccggccgctgtcgtcacggccataatgatcaaaagacctgtcgttaagacggctgcttgggtgaaagccacttttccgcgcgttgtcggcgcagacagaatataggccattgacccttgatccacccgctttgccaaaagctttgtcgacagcatgacagagaagatcgataagatcacgataaagattaatccgtaatattctccagatataaaatcttcaagattcccaagtccgttttcaaacccaaaagcattgagaaagccttccggcatcgatttgatcattttctcaatatcctccgcattgcccgcgatgcttggataaatgcccagtatcaaaaggatataaaatgcggagcctaccccgtagctcatgattcctttcatgtttgttctcagcatttgtttatacagggagaggttcattgcgctgtcccctttctgttatagtagttcataaaaatttcttccaagctttgtgatgaagcatcaatgtgccgaatgtgatatttggcggtttctttaataaattgatcatggttccctaaaacggccactttgacgcggttgtccgtccgggactcaatttgcagacttgaattcatgaaggcgggaatgtcgcccgtgttttcaaatgtgacttcaaatacttttcgctgcatcgactgcagttcatgaatatccttgacggcaatgatgatgccgtcttttataatggctgctctgtcacaggttctttcgatttccggaaagctgtgggaagacattaaaaacgtcgttcctttcgctttttcttcgaggacgatttcaataaatactttttgcatcagcggatcgaggcctgatgtcggttcatcaagaataatcacttcggggctgtgcataaaggcggcgacaatcccgaccttttgcttcattccttttgacatttttctgatcggagtatgaacatcgaactggagccgttcaataagatcattgcgcttggctgtatcttttaagccgtgcatgtctgccatgaaatcgagaaattgttttcccgtcattccttcgataaatgcaatctctccggggagatagccgatatgccgctgaatatcgccctgctgcttcaaaacatccattccgtttactttaatgtcgccttgatcaggcttcataaaccccatgatatgtcggatggtcgtcgattttccggctccgttcggccctaaaaacccaaaaacttcacctttttgaacatgaaaagaaagatcaaagatacctttgccattggaaaacttcttcgtgagccgttcaactgtaagcatgtggaacctccgtaatgaaaataatgaaattttaataattataaattacataatttattttaagttcttatgaacttttttgtcaatgaaaattaatgaaatatatttatgttataatttcattaagaaagataagtaaggatggttatatgaacggatttgaaaaaagggctttgctgattaaggagaagatcaaaaagacggctttggatatgctcaaaacatgggagccaaagcgcatccggataaccgatatcgcaaaagaggcaaacgtttcgcaggtgacgatttataattactttggaagcaaagaagcgctcctgaaagaggtttttaaagattatatcgatcagtccatcagcgagtttgaagaatatatgaacaaagatatttctgttaaagaaaaaattgaattgatgattttgcaaaaaagggcagccaataatcaaaaattcgctttaacggtcatcaaagaggtgatgatcgaagacagtgaaattatggattatgtgaagcagcaatacgatgaaaaaatcattccccttatgctccaaatgattgaagaaggtcatcggacaggcgaaatctcttccaaaatcaccgcggaaagctttctcatctttatgaatatgatcattgaacattcaaaaacattgggtaaagcctttgaaaaaaacaggaagtttacagaggaaatgctgcacattttcttctatggcttgtgcggcagacagtagtgataaatttgacatctctgtcatttctgtgaacgcttgaaacaatttccttgcttttccgtatataaggcagatacaaaaaacgaaaggatttactaaacgatgaagcactcctttttcttttttatgttcattgccttttttctcgtcactggtttttctgaagcaggcaaatccttttcgatcgagcgggctgatatacgcgcaacagtaaaagaaaacggcgatttaagtgtagaggaagtttacagatacgattttaaaggttcttttgaaggggcgacaagatcgttcagcgaagaaaccgcgagccgcctgaagaattttaaagcctatctccttcccgaccaccggagaaaaggcggtcaagccatcccgttaaagacaaagaaggaagacgggacttattttgcttattcggcatcaaaggatgaaacgaaaaatgtgatgtttcgctatgtgatcgaagatgccgcacaaaagtttgaagatacgtcgattttgatccattcattttaccaaaaggcaaataccgatttcggccgcgtaaagattgaagtgcgcctgcctgattcggtaaaggcacgggatattcatgcgtttttgcgtgaaaaaggaaacggaaagattacgaaggtgaacgattcatcggtcacctatgagacaggactctatcgcgcaggcacgggctccgagctgaggatatattttccgcaaagcgccttgaaggaggcggtccggcacccttcttaccagacaaaggatgagctgctgaaggaggagagagacgaggcgaaacgctacgctgagcgggatgaacgaattgccggcgctgaaaggatgattttgattttttcggggattgtggggttcatggtcatcatggctgtcatgctttcgtttttgaagaagagacgccgcgccatgctttcgtttgaagaactcgagtcctttgatcccgtgcttgtcgcatttctttacaaaaaaggccgtttcacagaccgcgatctcctggccggcctgctttcgctttatcagcggggattggtcactatgcagaaggtgcaggctgaagagaggtttctcgacgatcctaaggcgcctgatgacacatatgaatttgaattctccggaagcaaggcagatttgccaaagcctgatcagctcttaatcgaaaaactttttgagcagacgggcagcgatacctatatgttcaggctggattccctcagcgggccgactgaggaggaatgcaagcacaaggagcagctgggaaaatatgaacgaaagaggatcattcttcaaaacgtggttcaaaaatggacggaaagcgtcagacaagcgcctgaattcagggaactgtttcaagaaaaccgctggctgagaatgctgtcgctttcactgctttcagtccataccgggctcctgctctttattctgtatgcagatgtggtacatcaggccggattcatggcggcttgcgtcatatttggttttgcactgtcggcaggcattgttcttgcgaagtcaaagctgtatacgattctgtttttggccggattgtttttggcgtctgtttttaccgacagcgttcataccattttgtattacggcatatgcgtcgggctgtctattttattaattgccttcattccggccgtgaaagaaagcaggtatgcctccatctgccgaagatcgattctttcctggaggaaccatctgagaaaagaagatttgttctcagggagaagcctgtcacaaaacgaaaaaacgatgatctttgcaattgtgcttgaagtggaggatgaatctgccgtgtggctcaatcaatcagcaaacaggcttgattacgcttcccctgtactgggtatggctgcagccggctgtttgcattatccgttttacagctggcagctgccggattcgcagcagcacgccggtgcatatgatgcaggcggttccggagcgggcggaggcgacggggcaggagctttttaagttgaaaggggctgtcgcaacgacagccccttcagattatttcagttccccgcattcgctgttcagcagttttggttccgcgggtgacaggttgatgtccgtacgcttttgccaagccgaacaccggcatgttatggtaaaaagcctcatagcgcccttttggaaccgaatacgtttcatgatagatgccgacagcgcctgatgcggctgttttctgataaaaacggcgccaagccgccatatgtttatcaccctttgcatatgctgtcaaatcttcgaaagaacgccaatattgaataagacaaatcgtcctgaaattgatgaatgattccattgctaaaaagccgaggtttttgttttgataaagctcctttatcatagggggcatggcggtaaaaaccggccaccatttatgaacagcatgccacttgtttactctcatcccgatcacaaatacaacgacttcatcttcaggggcggccgtaaaaggcttgttgatgatcgttttacccattggtcccttcctttccattcagccgattgattgtggcctcacaccattcaattccggccgaggtggtgcgttttccataatccaacgtgaaaagccagtactctctgtcctttgaatgggagctgcacgaaagaattgactgctcgattgctttatatgcttcaagccgttcttcaagcttttgttggtactccttcactttcaaagcggttttctcccgcgattcttccttgctgaaaaacagcttcagcaaaaactcgtttttttctgaagcgatgtcattgatcggttcttcaagccagctctgcagcgctttttgaccttcagcggtaatcatgtactcttttctgtcctgctttttgtccgagagcgccggagaagccgcggcccagcctgcttccgttaattgacgcagtgcgggataaatttgcccgtagctgattttccaaaaatgattcaaactttggtcgatcattcgtttcatttcgtaacccgttcggtagccggccgtaatcaatccaagcagcgcgtaagtcgtgtgatttctttttgtcatacaaaccgcctttctatatctatttgatatatatcttttagatacatcatatcaaaggcgctgacttcgtgcaatcgctactattgttgtcgataatttgaccgggatgaaaatgtgataaaaaaatatcgaaaaaccgcgaaacttttctctgaatctttccgtatatatagttaagcaggttaaataatgattcattggtcttgtatttgtaaagatatgaatcacgctggcgtgataattggatctttcaaactcttattctcatccagcactgtgatctttaaggttatgattcaacggaggagtgaacagtttggctatttctttagagaaaggtcagcggattgatttaacaaaaggaaaagcggggctttcgaagattttagtcggtctcggctgggatccggtagcgtccggaagcggcggtttttttggaaagctgtttgggggaggaaccccgaatattgattgtgacgcatccgtgctgatgctggaaaacggaagagtcacagagaacaagaacgtcatttatttcggaaacttgaggagcagatgcggcagcatcgaacataccggagataatctgacaggcgaaggcagcggagatgatgaacaaatcattgtagatttgcaaaaagttccttcgcatattcataagcttgtctttgtcgtgaatatatacgattgcgtgaaacgaagccagcatttcggaatgatcgaaaatgcctttatacgcatcgtcaacatgaatgatcgcagtgagatggtcaagtacaatctgcgggacgattattctgggcggacaagcctgattgcgggcgaaatttaccgtgacggcgccgagtggaaattcaccgctgtcggagaaggcacaaacgatacgagcattacggaaatcgttaaacgctacgcctgacattcatataagaaatggggagatcaacatggcaatttcattagcaaaaggacaaaaaatcgatttaacaaaaacaaatcccggattgtcgaaagttgtcgtcggccttggctgggatgtcaatcaatatgacggcggtgctgattttgacctggatgctagcgtgttcctgctcaacgcagaaggcaagtgctcttctgaaaaggactttattttctataatcagaccgagggcgcaggcggagctgtcatacatacaggcgacaatcggacaggggaaggcgaaggagacgatgagcaggtaaaaatcaatttgaatgcagtgccggccgatattcaaaagatttcttttgtgattacgattcatgaagcggaggctcgccgccaaaatttcggacaggtgtcaaatgcttacgttcgcgtgatcaatgaagactcgaacgaagagttaatccgctatgatctgggtgaagatttctcgattgaaacagcgctgatcacgggagagctgtaccgccacggaggggaatggaagttctcagcgatcggctcaggctatcaaggcgggctggcgaggatcgccaccgatttcggcctgcaggtcggctgattttgaagatccggacagcaggcgccggatggcgtccgttggtccggctgacattttcttaaggaggtagtatcgatggcgattcaattatctaaaggacaaaggatcgatttaacgaaaacgaaccccggtttgacgaaagcgctgatcggtttaggctgggatacaaacaaatataccggcggcgccgattttgacttggacgcgtcggcttttcttgtcgatcagaacgatcgatgcatcaatgatcacgacttcgttttttacaacaacctcgagcatccaagcggcgccgtgattcatacgggcgacaaccggacaggagaaggtgaaggcgatgacgagcaaatcatcgtcgatttctcaaaaatccccgctcatgttgaaaagatcggcatcacggtgacgattcacgaggcggaaagccgcagccagaactttggacaagtctcaaatgcgtttgtccggctcgtagatgaatcaacaaatgaagagctgcttcgctttgacttgggagaggatttttcaattgagacagcggttgttgtttgcgaattgtaccgtcacggaggagattggaaattcaatgccatcggcagcgggttttccggcggattggcatcgctttgccgcaactacggcctgcaagtctagttttgccggctgagtcacctttgcgtgattcagtcttgctttttcatcattaggaggtaacgaaagtggatttatttcatcatattatgtcaatttacgcctcatttttcgattgggaaatgtgggtggaagtattaacggaccctgtttcctgggggctgatcggctcgctggtcgtgctggaggggcttttatctgcggataacgccctcgttctcgccgtcatggtgaagcaccttccggaaaaacaacgcaaaaaagcgttgacatacggtttaatcggggcctacttctttagatttctattcattggactcggtatgatcctgattaaattctggtggatcaaactgctcggagccgcatatctggcatggctcgtcatcaagcacttcttcatcggtgagggcgatgatgaagcaaacgccatcaaaaaagacagctggatggtacgcgttttcggggtcttctgggcgactgtcatttcggtagagctcatggaccttgcattttcggtcgacagcatcctggcggcatttgccgtatctgaaaaggtatgggtgcttctgatcggcggcatgctcggcatcttgatgatgagaaccgttgcgaaattcttcttgacgctgattgacaaagtgcctgaacttgaaacaacggcctttgttttaatcggaatcatcgcactgaaaatggctgcgagtgtatggcatattgaaatgccgcacagcgtcttctttatcattctgattattgcttttgccgcaacatttatcattcactatatgaacaagcaaaaagctgtaaaagagcaaacggcggcttcaaaggaagaataacaaactgcaaaacataaaggggggagtagatctgctccgccctttttttacatcaaaggggtgtatgattcctattcaaagaaggtgacccatgtgcaatactttgattttttatccgcctctcaaaaagaagatgtctttttcaaactgccgggtacggttacaaaggactctccgaagcgcattctcgagtatgcgcttggagctgcgctctatgttccggggaaccgaaaagatatagcagatgtcatcatcaataacaagtatccagaactgtgctcggtcgttttttgccttgaagattcgatcggcgattgtgaggttctacaggctgaaaacaatcttgtcagtcaggccgatatgatttatcaggcgcaaaaactgcagaacatcaacagcgatgtgctgccgctgatgtttatccgagtgcgggaacctgagcagatgctcgaattgggcaacaagctcggccgcgcgcttcacttgtttgccggattcgtatttccgaagttttcgatgttgaatgcagagcactaccttgatactttaacgaagctgtcgcaagaatccggcattgtgctatacggaatgccgatctttgagacacctgatctgctggcgatggaaacgagggcaaaggcgctgcaggaattaaaatcaacgcttggcttttatcaggatatcattctgaatatcagaatcggggcgactgatttgtgcggtctctacggcttaagaagaaaaccggaaacgccgatttacgacattttggtcatctctgatttcatcaaagatatcgtcaattatttcggcttgcaattcgtgatttcggggcctgtctgggagtactttggagatgcttcgcgaacggttccgccttttgcgccgaattgggctgaggcgggggaatcttcgcttgtgatcaatcggtatatggacggattgatcaatgaaacgcttcttgacctggccaacggcattcacggaaaaagcgtgattcatccgtcacaaataaaagcggtccaaagcctgcatgttatatcaatggaggattatctggatgccttaagcatcgtcgaaagtgccgacggcacccgcggcgttgtaaaaagttctttctcaaataaaatgatcgaaatcaagccgtaccttagctgggccaaaaaaatattattaaaggctgaaatctacggggtatatcatgaaaaccgcagctatacggatatacttagagcgtccaaaccgttttcaaaccttggatcgttcgggagttagtctgggacgggtgattggaaatgggcaaaacgtttaaaagatcagtgcttctactgtaaaagagccgcactaccaccatgatctcaaaggcagacattgtgaatttctcaggagaaaacaaatgaaattttaggatgaacagccatgatgaaaatagtcgatctcacgagcagcgagattctcagttcccagcaggcatgtgaagagtgggggattgattcgtctacgctccgaaagagagcgcatgattttcctgcgggaacaatcagaaagttcgggacaacctatgccgtgacaagagcgggcatgtgtgccgtatttggacgtaagagcgacactgactcagaagaaaggggagacggctgagcgctatgaatcaagagattaatattcaaaacgccctggtcaatgatgatgaatggaagcagatcatcaagaagccgctcccggagagaaccccgtatgaaaaaaacagtcatttgacgataagccgtctggcgggacggattcttggaactccgcacgatgaaacggattactacatatatctccatgagctgtatgcgtccggtgatgtgcatgtgttaagcgagacgcttgataagaccatttctccggaaaggtttcaggccatacagcggatccatatggtgaaccagaaagaaaaaggactttccgtcaatcggtttgccgcttttcttgacggggagcagctgattcctaagcaccctgatcccgctatgcaccggcatttaaggaaggcgcttatcgaagtgctgcagatgtttcagtcctttcatgaaaaaggattgaacgatccggattttcgccgggtcctccttgaccttgtcaaatggatgggcaaccatttggagaagtggctgaaaggggccgactgcgaaacggcgatgccgaaagtggtttggtacggggacaccaccaaaagccaacggtattttttatactatttgatgcttgtcggatgcgatgtgctgctgtttcatccggagggaaaagacgaatttcgccagcttgatcccgagcaaaagctttcttttgtcttcacatacccggacacgtctgcattagagccgttcccgactgaaaagccccagcgcaaagcaacggtggcgtaccgttccgcgaaggagctggatactgtcctgcacaatgaggattcgctaatgtacaaaccttggcagttcagggagcatactccggcctctgtgactttgaagacaacatatgatgaactgtttttaattgcgaaggaacgagcctttatcagacctaattttcaggcgtctaaatcaacggttaacattccgaatttattcgcgatggtcatgggcgtctccagcaatgaaaaagagtactgggaccgtctgcagacactgacggagtataaggagtcgcatacgatccggcgcttcccgtttacaaaggaagagacgtcgaattatcaattccattacagcgatgcgcttgatcaaacggggatgatcgatccaggccgtttaatggagagcaatatatggcgctacaagcatctgcctgagggagtacagcgaggcattgcccaagcggtttccaggatgtgcaaaagcccgaagatgctggctttgaacaatgaaaagacagccgatgtacagctgtatttgtttacccaagcggtacagcttccggcagcgctattgaatatgattcagacatttgactattcacagaccgtgccgaagctgatcttgtatcacacggaacagacggggacactcacccggtcggacgcggccgccttgcttttgttaaatgaaatcggcattgacattatcatctataatccgccgggccataagtgtattgaccactatatcgacaggcagcactttgatacccattggcttgatgaaatgtccttcaaccaggagtttaaagagccgtcaatcgtccggaagttcatcaataaaatcttttaaggagggggccattctgatggcaaatccaaatgaaacaagcatcgtcaatattagcaaagaggaagagatcacggttgaaaaagcggaggacatccgtgcgaaactccgccaggagccggatgtgcaagctctggcccgacaaattgacgtgaaaaaccaagtggagcttttagaattcggtaaggagcccgctcttgaaatatccaagttctctgaccgcattctttccatgatgagaacgaacagtgtgacagattcaggcgcgatgttgacgcagctcggaaaaatcatggaccgctttgacaagaatgactttgaagaacaaaaaggcttgctctctaaattatttaagcgcggcaacagcatgatcgagaaaatatttaaaaaatatcaaacgctcggcggtgaaatcgaaaaaatcaatgtcgaaatttcaaaatataaagatgaaatgacaaaatcgaccgtgacgcttgatgaaatgtatgaaagcaaccttaaatactatgtggagctggaaaaatacgtcgtagccggccagatgaaaatagaagaattgcagcggctcatccccgaatatgaagcgaaagcggccagcggaaaccagatggcgcagatggagcttgatacgcttcgaaacggcattcaagcgctggaagaacgggtgtatgatctcgatatggcgcggatggtcgcaattcaaacggcgccgcaaatccgcctgctccagcgcggcaacacaaagctgatcggaaaaatcaactcggcattcatcattacgattccgattttcaaaaacggcatcatccaggccgttaccgccaagcgccaaaaacttgtcgccgattcaatgagcgaactcgaccgccgcaccaacgaaatgctgaagcgcaacgcggaaaatatttcaagccagtccgtcgaaatcgccagaatgtccggaagaccgagcatcgatattgaaacgatcgaacaatcttggaatacgattgtcaaaggcatgcaggagacgaagcagattgaagatgagaacaaacgcctgcgcgaagaaggggcaaaacgcatattggaacttcaggacaatatgaaaaaagccgctttaaacggttaaaaaggataaagaagaagccgcccccagatcagctggcggcggcttcaaatatacaaaaaatcaccgccatgataggcggttttttatgttatgctagagaaagagaatcacatggtaaaaaatatataaacatgaaagaggtggaagtatatggccgctttatggctggcattcggcggcggtttcctgtcgtttatttctccttgctgcctgcctttgtatccatcatttatttcctacatcaccgggatttcggtcggcgatttgaaaaaccggcatgcaaagcatatcaaacaatcggtgatgattcacgcagcggcttttttggccggtttttctgtgattttttacatattgggtttctctgccagctcggttggtctgctgtttttgcaataccataacttaatccgcatgctgggcgggatatttttcgtcgtcatgggactgttcttactcggcgttttccggccggcttttatgatgaaggagcggcgcttttcgattagaaagggaaaaataggcctgctgaattcaatgctggtcggaatgatttttgcggcgggctggacgccgtgcatcgggcctatattcggaacgatcgcatacgcaaattttcagaaccctgattttgggagcgcattcatgatgatcaccgcatattctttaggctttgccattccttttttgctcatggcgttttttatcggaaacatcaggccgcttatgaaatattcgaatatgctcatgaagatcggaggcgcgctgatgatcgtcatcggcatcctgctttatacggacaacatgatatggattaacatctggtattcgaatttgacgaatctcttttgaaaaacttccgcatgctgcattatgtgagtaagattgtgaaaaacagcaaaatcgcgttaaataaactatggatgatcatcgcaggtataatcgatcgtgttttttcgtatgtccaggcaaacacgagccctgttccaaagttaacggccagggtgttgtatgtggggatatgagcgatcataaagagggcgctgcttgcaacaagtgcccatacaaccccgaattcagcgcggaaccagcggtaaagaaaaccgcggtaaaacaattcttcgtagatgggagaaacgatgcaggcagaagcgaaagacattgcaatgctcaaccatgaaggatcggcagtgatcgtttttgtttttgtattttcgtagcctgcgccgaaccaaatcaggatttccataacggcaaacgtcatcacgattaaaaaaaccgtccatcccgctatttgaatcaagtatgcaggggcgaaccgggagattccgatttcccgccaagacagacggtccggctttaaggcgatatagtacaagcttagaataaaaacggccgccattgcgatactcatcaacatggctgaaagcatgccttcgcctaaaagcagatccaaagcattctttaataaatattcaatgaaaatcggcacggctgcaaatgcgatcaaaaacaagcagaccagctgctttttgttccaaggatttttccattccatcacaaaaccctcctgtttttaagataaaatcattttaaatggtgacgtaacgtaatcttcaagcaatattttaggagggagatatggtgaaagaggaactgacaaccgggcgggtggcgaagatgatggggatatccgtaaggacgctccgctactacgatcaaatcggtttattaaaaccgggctctacactgccgaatgggcgaaggcaatattcgaaggaagatttgttagagctcgaaaaaattatgatcttgaaatctgctcaattttcattggagcatatcaagacgttaatgaatcaattggatacaattagtatcatcgaaatgcataaaaggcgccttaattcggagatcgaacagctgacgaagagcctggagcatacaaatactttgctgaacatgtatcaaatcgaaggaagcttgagctgggaagaccttctcaagctcgtcagacagccccggcataaaccatggaaggaatcattctctgaagaggaggctgagattttagcagaaaggcttccgaaggcggagagtgacgatttcatcacaaagcaatggctctctatcatcaagcggattaagctgtgtttaaaacaagaggtgccgcctgaatctgaatggggaaagcaaattgcggaggatatcatatgcctgtctgatcattcgtttaagggacatgaggatttagccgatcgattctgggaggttcgcaagtctgaggagccaaacgggctttatccgcttgacagcgggattatggaatttgcggagagagcgattgaatctgcatttcatgattcaggaggatcagggtgatgatgagcatccaattgtcatgatcgggccggataaccaaaagatcaaacaggatatgccgcatagaaaaccgcccgaaaagaatcgagcggctaccccttaaattcggattgatttctcctcggctttccactgttttttccatccggcctgagcaaacaaaagcagaccgagcgctaaaaatgcaataacggtaaaggttaggaacccgcttgaatacgtacctgtaatttgcttcagcgttccgaggatattcggaaggaagaatccgccgattccccccgcagcgccgacgatccccgtcaccatcccgatctcttgttgaaatcgctgcggtacaagctggaatatcgcgccgttccccattccgaggcagcccatgccgataaataatgcggctgtgacaacgcctagagacgggagcatactgaccgagaacatgcacagagccactccgataaagaggaattgaagcagacgcacgccgccgattttatcggcaatcaatccgccgacagggcggaggcagcttccggatgcaacgacaagcgtgacaaattcgccggctcttaccgccggaacggcatactgggatgcaaaaaagtagcttaaaaagttggacaggccgacaaaacccccgaatgtcacgctgtagagaaggcaaaaataccaagtgtccctttctttgaaaacggcaaaatagtctttgagcggtttaggagccggctgattcggaggttctttagccataaggaaatagctgaataacacgagggttaaaggaatcagcgccagtcccatgacgccgttccagcccacttgctccgcaaggcgagggccgaatagcgtagcaagcagtgttccgctgtttcccgccccggcgatccccatggcaagaccttgcaagtgcggcggataccagcggctcgccataggaagggaagcggaaaagcttgcgcctgccacaccgagtaaaattccgatgatatacagctcggcgaccgatgaaccgaactgccatccccataacaacggaatcatcgtcaccagcattccgccaacagccgtctttttcggtccgaaacggtcggttaaaatgccgagcgcaatccggaaaaacgatccggccaaagtaggtatggcgacaatcaatccgacctgtgaaggcgataaatcaaaatcagccgtaacataaacaccaagcgcccccagcaacacccaaatcataaagctgacatcgaaatataaaaaagatgacaacaaggaaggcgcgtgtccgctcttcctcaaatccgccaatttcaattgcaacactccccatccgatagattctagaatttatcatgacaaaatcgaatagggttggcagtatttttgtaagctttactaacaaactaaaagattgaatatttaaaatgttagtttggacagcactatagcaggcgataattgaattatgctgaagaatagtggtgttatgagcgctgaaaatgggaaaccttatattgatataggcccgatgcacttgcagataaaaccgtcttttgcaacgcgtttatcaatttttctttagacataaggcatatttttaccagaaaatgtacaaatttaaggaagaaatacgtggagacacaaaatagacataaataaaaatgtatatcacttgaaaaagtatgtgaagtattgcacaatatgaatgtgaagaatttcacaaacagcttagtttaaaacaaacggcaaaggaatgatgagtcatgagaaaccaaaaagtcaatcgtacagttttgatcggtgcgggttttgttggaagcagctatgcatttacgttaattaaccaaggtatcacagacgaacttgtgatcattgatttaaataaagacaaagcaatgggcgatgttatggatctcaaccacggtaaagcatttgctccgcatcctgtgaaaacatggtacggcacatatgatgactgcaaagaagctgatattgtctgcgtatgcgccggagcgaaccaaaagccgggtgaaacccgccttgatctagtcgaaaagaacttgaaaatttttaaaggaatcatcggagaagtcatggccagcggttttgacggcatcttcctcgtcgctacaaaccctgtcgacatcttgacttatgcgacttggaaattcagcggccttccgaaagaacgcgtcatcggaagcggcacaacgcttgacactgcccgtttccgctacttgctcagcgagtatttcggtgtcgctgcccacaatgcgcacggctatatcattggtgaacacggagatacggagctgcctgtctggagccatgcgaatatcggcggagttcccgtcagcgacttgctgaaaagaaatgagaaatacaaagcggaagatctagatgaactgtttgacaatgtaaaaaacgccgcttaccacattattgagaaaaaaggcgcgacatactacggagttgccatgagcctcgcacgtattacgaaagcgatttatcgaaatgaagaagcaattttgaccgtgagcgctcatcttgatggtgaatttggagaaaatgatgtttatatcggagttccggcggttgtcggccgatgcggagcgagggaaattgttgagctcgatctgaacgaaaaggaaaaacaacaattcaagcatagcgcaggtgtgttaaaagcaattctaaaaccgcattttgaactgcaggcgtaactgaacaccatgaagatactaacatcatgaagattgcgagatgatgaaaatgtggcagcagatatacgatccgtttggaaatctgtttatcagcgcttttgccgccatactgccgattcttttctttcttcttgcactgaccgtgttgaagatgaaaggaatcattgcgtcatttttgacgctggcggtcagctttattgtagcggtgttcttctttcacatgccggctgcgaaagctgtctccgccgttttacttggaattgctaacggcctttggccgatcggatatattgtcctgatggctgtatggctttacaaaatttctgtcaaaaccggaaagtttaaagtgatcagagcgagcattgccggaatttcgtccgaccagcggcttcagctattgctgatcgggttcagttttaacgcctttttggaaggtgcggcaggcttcggtgtgccgattgcgatcagcgccgttcttcttgtcgagcttggttttaaacctttgaaagcggcatccctatgtttaatagcgaatgcggcatccggagcctttggagccatcggaattccggttatcacaggagcgcagatgggaggcttaacaccggttgagctttccagaacgctcgctttgatgctgccggtcatcgctttctttgtcccgttcctgctcgttttcatattggacgggtttaaaggaataagggaaacgctgccggctcttctcgtattaagcggaagctatacggcggtgcagactttaacaatgattagtttggggccggagcttgccgacattttggccgctttaatcagcatgggagcgctggcgctgtttttgaaaaagtggcagccgcgccacatatacagggaaaccgggaatgaacatgtgcccgctgaaaaatatcgtgcagcagacattatgaacgcttggtcaccgttttatattttgaccgccgtcattgcggtgtggagcctgcccggttttaaggggctttttcaggaaggcggattcctgaagcaaacgacaattttattcaacatgccttttcttcaccgggaagtgctgaaaacgccgccgatatctccggaacaggcaccgcttgatgctgtgatgaagcttgacttcatttcagcgacgggtacggcgatcctgatcgcggtgatcatcacgattgtgctgagccgaaacatcagtttccgcggaggactttccagtctgaaagagacggtcaaggaactgtggcttcccgttctcaccatttgctttgtgatgggttttgcaaacttggccaattatgccggattgagttcaaccatcggactggcgctcgccaaagcgggggatatctttccgttcgtcagtcccgtattgggctggatcggtgtctttatcacaggttcagtcgtcagcaacaacgcattattcggccacctgcaagcagtcaccggagcgcaaatcgggacaagttcggctttgctgcttgccgcaaataccgcgggaggcgtgatggccaagctgatctcaccgcagtcgattgcgattgcaacagccgcggttaaagagacagggcaggaatcaaagcttttcagccaaaccgttaaatacagcctggttctgcttttcatcatttgcatttggacgtttgcgctatcaaagcttggcatataaagaagagccttttcccattgcgggaaaaggctttttaagctgcttgttctatcatgtcctctttttgaatacattgtacaagttatccgcggaagggggacgcgatatgttgaacatcttcctgagctatgtgtttttgggtttgtcattggccgcaccagtcggacctgtgaatgccgcgcagatcgacagaggcatgaaaggcggattctttcatgcctggctgtttggccttggcgctgtaacggcggatgtcctatatatggctttaatctactttggagttgcgcaatttttgacagcgccattcttaaaaacgtttttatggctgtttggtttttttgttttgacctatacggggatcgagagcctggtcaaggcgaaggaagtatcgctgatgagaggtgcgggagagaaagggtcataccgcaaatcttttttgtcggggctggtgatctccctttcaaacccgctgagcatcatgttctggctcggcatttacggaagcattttggcgaaaacggtagaggcgtacgaatcataccagctgctgatctgcagttcaggcattttaatcggactttttctgtgggacttggccatgtcttttctagccgggacattcagaacatttttaagcccgcggatgatccagggaacgacttggctcgcgggcatcagtctgatcgtatttggatgctacttcggctatcagggaattctcgaactgctgcaggcggggcgctgatcatgtctgcccgtttttctcttcctgatccgcccacttttttttcatgagcatcgtcacagcagcaataacggcaagaaagagaaggctcacaaaaaaaccgggtctgctgtttttttcaaataacgtacccgaaacggcgaacaaaatcaggacgagcgctgtgacaatctggacattccctttcattttcggttttgtgagctttttgctggaaagcaggataaacatccagttatagagcagcatcaagctggcggccgtcgtcatgtgttcataaagctgcttcggcaaaatgagcgacaagacgatggaagcagcgagaacgagcactgtcaggccgagtgccggccacgatactttcgccttttcttttttggcaaagcaggccggtgcatccccgtttttcgccattgttcccatcagtgtggtgacggcgaacagggaagcggtcagcgttgaaaaaccggcaataataaaaatgccgttgaaaatatccatgatcaaatcgagatgaaagtcttttaatgacgtaataaacgggctgttctgttcggtgaatgttccgcgtggtacaaggagcatggccagcccgatcgatacgacgtagaccacagcaagggttatgagcatcaggctgcctgactttgatgaatccttcgggtcttttaagtgaatcgccatcagacccatgacttcgattcctccataagcgtaaaatgtataaatcaaccccgtccacaatcccataaagccgaaaggaaacaattcgtgaacccggtcagggaactgcacttcaggcgtttttccaggcagcagcccgcacaatgccaagacagcgatgatgataaacattaaaatggccgccgttttcaacacggccaatatgttttccgttttttcaaagctgctgcgccctgtgaaaatgacgatcaatccgagaatcgcataaatagaggcgaacacccacagcggaatctcgttaaaccaatggcgcgtaaacagggaaatcgctgtcaactggctcccgatgatcagcatttccgatgaccagtagacccagccattgctaaaccccgcccaattgccgaaggcctctctggcgtaagaacaaaaagacccttcaacaggatgatctgccgttaatttcgccagctgctgaaaaacaagaaaagtgccaagggcagcaagaagaaaggcggctaatacggaaaagccgcttttcttaatcgcgatgcttgagccgaggaaaaaccccgttccaattgtgcagccgaccccgatcatggacagctgccaccattttaaatctccttttttcgcttgtcgtttcatcgtttcaacccctctaatcttcttgttattttgccagggggctccgtttttattcgcaaagggggaggttctttgcgcacctcaatattcactttgaaatgagacatatgctatagttaaagacataatcattacggttcattcagtcaaaaggaggagtgacggatgactttacaagaaaaaatcatgcaggaactgaatgtaaagccttctatcgaaccgaaacaggaaattgaaaaaagggtcggttttttaaaaagctatttgaaaaaaacgggtgccaaaggctttgttttaggcatcagcggaggacaggactccacattggcgggcaggctggcccagctggctgttgaagaattgagggaagaaggcattcaggcggaatttattgcggtccgcttgccttacggtgttcagcaggatgaagatgacgcccagctggcgctgaaatttatccagccggacaagtcttttgcttttgacattgcttcaactgtaggttcatttgctgctcaatatcagtcagtcacgggagaggcgcttgccgattttcacaaaggcaatgtaaaagcgagagtccggatgatcacccaatatgcgatcggaggtcaaaatcagctgctggtaattgggacagatcatgctgcagaagctgttaccggattttttacgaaatacggagacgggggcgcagaccttttgccgcttacaggactgacaaagcgccagggcagaagcctgctggaagagctgggagcgccggagcggctttatacgaagtccccgaccgccgatttgcttgatgaaaaacctcagcaatccgatgaaacagagctcggcctgacatatgataacatcgacgactaccttgaaggaaaagccgtctccagcgaggtggcagaggccatcgaaaaacgctacaaggcatccgagcacaaacgccaagtccctgcttcaatgtttgacgactggtggaaataagctaaaaagaggctgaagtcagcctctttttttattaacaggcaccctatatcattacagatggaattgtcatatacttaagatatttgattcctttatgcagggaggagtagaagctggaaatgaatgccgcaataagagataagaatattgtgctgatcgggtttatgggcgtcggaaaaacaaccatcggccagcttgtgtcaaagaaattaggccgtgactttatcgatatcgaccacgagatcgaaaaagactttcaaatgaccattccggagatgtttcagcaaaaaggggaagcgtttttcagacagacggaaaaagaatatatttttcagatgtgcgaacatacaatgggcaacatcgtatccttagggggcggcgcttttcagcaggaggaaatcagaaagaagtgcctcgaacactgctttgtcatctttcttgatttaagatgggagaattggaagcagcggatggatctcttgattgaaaacaggccggttcttcataaccgcacaattgaagaaatgaaacagctgttcaatgaaagaaagagcatttatgcatttcaccatttaaaagtggaaaccgataaccggtctgccgaagaaacggccgactatattgtggagatgctaaagcttggtcaatcttaaacaaacgtttaattaagctaaatataccggaataagcaaagagccaatggtctgtctgatcattggctctttccgttatccgcagatgaatgccggatttttcggccttgtttgaccgtttgtccgtttgatacagtataggggatcaggatgggcatcacgttacaccccgccaccaatttttccctggataaggtttttccgcccctaaggctttaaaaaagtcgcttattgccggcccggacactataatgtaaataatagaaacgatagactggcggtgtacttatcatgaaacagcgaattgaagaagaactgaaaaacattgaagcaacatatggcgtcaaaatcctctatgccgttgaatctggcagcagggcatggggctttccttcacaggacagcgattacgacgtcagatttatttatgtccatcaaaaagactggtatctgtcaattgatgcaaagcgcgatgtgattgaactgccgattgacgattctctcgatatcagcggctgggagctgacaaaagcgttaaggctgttccggaaatcaaatcctccgcttctcgaatggctctcttcgggaaccgtttattatgaagcctattcgctggcagaaaaaatgaggcggctcaaaagccgcgccttttctccagtctcctgtatgtaccattatctcaatatggcgtcgggaaatttccgagactacctgacgcgtgaagaagtgaaaatcaaaaaatatttttatgtactccgcccgattctggcttgccagtggatcgaaagccgccggacggttcctccgattgaatttcaggttttgcttgacgaacttacggaagacggaccgctgaaaacagaaatccatcagctgcttgaaaggaaaaagaaaggggaggagttcaatcttgaacctcaaaaccccattctccacgaatttattgagcgtgaacttgagcggcttcagacagttgccaaagcatataaaacggatcatgaagatctgacgcaggagcttgaccgtctgtttagagaaacgctagacgaggtgtgggcataaaatgatattccctttaagtattcttaaagggttttttctttgtatccatagggaaatggtttagtataacagaaagcgttttcagaaaaagcggggcggaacggcagcaaggccattcgccaaaaacgcattctgttctttaccgaagtttcttcctgattctattgttgtataccatccaagttttaggaagaaagtttctgaaaaaattccaccagatgtaaaacattgtggaaaaaccacaaaaatcgtcagcttttttgttttttcgaaatattgtgaatcgacccttggctcttataaaattaagaatataaagaaatatttcatgagatggcggggtgtgataatggaagtgataacaagagactttttcctattcttatctaaaagcagcatcctgaatcgcctggcgagaaattgggggagttccgtcgcgaccggaaaaattatcggaggaaaagattttgaagcttcaattccgattattaaggggcttaacgaacaagggctgactgtgacagtcgatcacttgggcgaatttgtgaacagcagggaagtcgcaagggagcgcacgcaggaatgcattcgggccattcagctgattgctcaggaacagcttaattcacatgtttcattaaagatgacgtcattgggactcgatattgaccttgaccttgtcagggataatatgaacagtattctggaatgtgccgagcagcaccaagtgatggtcacaatcgatatggaggatgaagtgcgctgccaaaagacgcttgacctctttaaggagttcaggcagaaatacgagtatgtcagcaccgtcctgcaggcttatttgtaccggaccgaacaggatttggaggagctcaattcattaaatccgtttttccgtcttgtgaagggagcttataaagaatcgccgaaagtggctttccctgacaaaaaggatgtggatgagaattacaaaaagctcattaaaaagcagctgctgagcggccattacacagctatcgcaactcatgacgacaagatgattgatttcgccaaagaaattgcgaatgagcatcaaatcggcaaagaccgcttcgaatttcaaatgctgtacgggatgcgcagcaaaactcagctggaactggtgaaggaaggctacaatatgcgcgtgtatcttccttacggagacgactggtacggatactttatgagacggcttgctgagcggcctgccaacatcgcttttgcgtttaaaggcatgacgaagaaataaaacgataaaaaggggagattagcatgacaacaccttacaaacacgaaccatttacaaatttcgggatcgaagaaaaccggaaggcattcgaaaaagctctggaaacggtaaataacgaatggctgggtcagtcctatcctcttgttatcgatggagaaaggtatgaaacggaaaacaagatcgtatcgatcaaccctgcaaacaaagaagaagttgtaggcacggtatccaaggctactcaggatcatgcggaaaaggccattcaggcggctgcgaaagcgtttgaaacttggagatacacagatcctgaagaaagagcggctgttttattccgcgcggctgccaaagtgcgccgcaaaaagcatgagttctctgcgcttttagtcaaagaagcaggaaaaccttggaatgaagcggatgcggatacggcagaagcgatcgattttatggaatactatgcgcggcaaatgattgagcttgcgaaaggaaagccggttaacagccgtgaaggcgaacgaaatcaatatgtgtacacaccgactggtgttacggttgttattccgccttggaacttcctgttcgcgatcatggccggaacgacagttgcgccgatcgtgacaggaaacacagttgtactgaagcctgcaagcgcagcgcctgtcattgccgccaagtttgttgaagtgcttgaagaaagcggacttccaaaaggagtagtcaacttcgtccctggaagcggagctgaagtcggggattatttggtggaccatccgaaaacaagcatcattacgtttaccggttcaagggaagtcggaacgcgcatttttgagcgtgcagcgaaggttcagcctggtcagacccacttaaaacaagtgatcgctgagatgggcggaaaagatacggtcgtcgttgatgaagactgtgatattgaattggctgcacaatcaattttcacatctgccttcggctttgcaggccaaaaatgttcagcaggttcacgggctgtcgtgcatgaaaaggtatatgacgaagtattgaagcgcgtgattgaaattacggagtccaagaaagtcggagagcccgacagcgcggacgtttacatgggacctgtcatcgatcaggcatcctttaacaaaatcatggactatatcgaaatcggaaaagaagaaggccgcttagtcagcggaggaaaaggcgatgattcaaaaggctacttcatcgaaccgacgatctttgccgatttagatccgaaagcccggttaatgcaggaagaaattttcggacctgttgttgctttctcaaaagtaagcagctttgatgaggcgctggaagttgccaacaacaccgaatacggcctgacaggcgcggtcattactaaaaaccgcgatcatatcaacagggcaaaacaagaattccatgtcggaaatctgtatttcaaccgcaactgtacaggggcgatcgtcggctaccatccgtttggcggtttcaaaatgtcgggaaccgactctaaagcgggcggacctgattatcttgcgcttcacatgcaggcgaaaacgatcagcgaaatgttttaaggtgtaagaaaaggggttaaacagggggacgaaggcagcctataataggctgccttcaaaaaaagagaaattagtctaaaaatttagataaacggcatcttggggggagattcttattcagaacgtacaattgatcatttccatcgtgatttacatggtagggatgctttatattgggtattacgcttacaaacggacagcaaacctctcagactatatgcttggcggacgaacgctcgggcctgctgtcacggcgctcagcgccggcgcatcagacatgagcggctggcttttgatggggctgccgggcgccatgtttgcaacaggcctgagcggttcgtggattgtcatcggactcgtactcggcgcttgggcgaactggatatttgtagcgccgcgtctaaggtcatacaccgaagtagcgggcaattcaatcactatccctgcatttttagaaaaccgttttcatgacaaatcaaagatcctgcgaatattttccggagtcgtcattattaccttttttacgttttatgtatcatctggaatggtttccgggggcgttttatttaacagcatatttaatttggattaccatgcagggctgtggatcatttcaggcgttgtcgtggcctacacgcttttcggcgggtttttggcagtcagctggacggactttgtccaaggcatcattatgtttgtcgcgttaattcttgttccgattgtgacggtcattcagacgggaggacctggagaagccttcagcgagatccagtcgatcgatccaaacctcctcaatatttttaaaggtacgagcgtcctcggcatcatctccttgttctcatggggcctcggctattttggacagcctcatattatcgtgcgctttatggcgatatcctccatcaaggaaacgaagaaagcgcgccggatcggcatgggttggatgatcttttcaagtgcgggcgcactgctgaccggattgctcggtattgcgtattactcgaagaacgggcttcacttggatgatccggagaccatcttcattcaattgggtaacatcctgtttcaccctctaatcacaggatttttaatctcggcgattttggcagcggttatgagtacaatttcctcccagctgcttgtgacatcaagttctctaactgaagatttatacaaaacactatttaagcgctctgcatctgataaagaactcgtctttttcggacggctttcggttttggcggtttccattgtcggactctgtctcgcctggacaaaaaacaatacgattctcggtcttgtcagctatgcttgggcgggtttcggagcgtcgttcggccccgtggtcatcttaagtttgttttggaagaggatgacaaaatggggggcgcttgccggaatggttgccggagcgcttaccgtcatcatttgggcggaagccgggctttccgatgttctttatgaagtgattccgggctttgccgccagcttgctgtttgtgtttgtcgtcagtctattgacgtcaaaaccggagcagcaggtgcttgatgaattcgagcaatacaaacaaacgctgtaacgatgacggagatggggaaccattctccgtctctctttttataggccttctcccccttctaacaggggattgatcccatttttttaaaagtcgcatataagtctatacaagagtgtaaaggagaagtatgattaagttaaaaacgagtaggagaaaggatatggaagagctattagaacaagttgtttctctttcaaacattaatgagatcattgactttatcagcggggagctgaaaaagccggtcatactggaaagcgcagattttttcttattagcttacaactcctattatattaaccattttgatgcagcaaaccagcaaacgattttctccaaaaaatgtccgctgccgatctttgaaaagttcgtcgaagaaggcattattgatcaattgaaaacgattccgactccttttcgggtaaaacagattgaagaaatcggcttaaaccagcgggttgtcgtcagcgccaagcataaagacgaaataatgggctatatctgggtgcaggagattgaagacaacctgtctgatgaagagcttgatttcttatatcaagcttcctttcatgtcgggaagatcatttataagaaaaaacgcctcaaacaagaaaaagaagaacaggcggaagagctttacaaaaaggcaattaacgatcagtttcaaacggaaaaagagctgaaggccgccgccgataaagcgaacgtcgtcctgccggccgtgtttaccgtcatggtgcttcaagtcgttgacggggaggatgaactgctcgaagatctaaaggaaacgatccggtcttatttaaacctgaaagacaacatcagtcacgtactggaggatcattcgaatatcgcaatcattgtcggcagtgtgtcgcgcaagcgttccgcgctggccgctgcctcagaactgatcaaccgtctgttgacccatctgcgctcgcaaatgctgccccttattttgatcggggtcggcaatgagtacagcagcctgctctccctcggcaaaagctacagagaggcgctccaagtgacgaaagcagcggagatcacgggaagccaagaacacattccctatgaatatcaaaagctcgggcttttcaaatatcttgaccaaatcgccgcaaaaaacgatcatctgcaatatgtaaacccggaccttcagctgctgaaagaaaaagataaagaaagccacaccgaatttttaagaacgcttgaaatctatctcgtcaacaattgcaaggtcaagccatccgcagaacagctgtttatccaccaaaacacgctcaactaccgaattaaacaaatattggaaatgacatcgattgatctcaatgattttaatacaagatgtcagttgtttatcgatttaatgctgatgaagaaagcaggctacaaatcgtaaacagaaaaagaaaagccggtacatgaagtgccggcttttaatatgtccgataaacgtaaggatctttcggctcttttattgcagaccaatccttcactttcagcacgggaattgtagatttgaaaggctgatagtattcggaagacagcgttccttttacatgaagccactggtcgtctttaatatccatattttcagggaactcgaccagcatgccatagacgccggagtcggcgatgcaatgaatgatgccgaagcggaggacaaacagctgtttgtcactgatcgcttcccctttaaaagcaaagccgtcgaattcgagcgttcggtcaaggaattctcccggataatgatagatcgtttccatgcccttcaaaaaatcatcatcttttaatgtaatatgctgtttttctttatactttttcagcgctttattcatcaattcatcatacccatcctggccgtagtagatgcttgtgtcggggcgcaggtactgggtttgggcataatgctccggctgttcgatcgctttgaacgagaagcccttcgacttgacgatattggaatcaagcgtcgctgccggcagaaaaagtccggtgcataaagggaagaagaacacgaaataaatgaacattctttgcagaaaaggcttatctttttcatgatcgtggtcatggccgcatccgcattcatggttacatcctttttcatccgagcttttcatataaatgtagaattgcacagctgtcaaaatggccagaagaataatagcgatgtatgaaaggtaagcgtatttcatattaatatattttgtcagattgccggatgcatgaagatgaaaaaagaaaaacgtaaacaacattaaaatgaatgtgcgaaacatgttctcacccctttaccaacagtgatccggctaagacaataacggcgatgtaggggattaagacaaacacaaagcgctttttgaagatgccgagcatcatcagcagatttttgatgtccaccatcgctccgaatacgagaaaggcgatgagggagccgagggaaaacgtactgctgaaagaagaagcgataaaagcgtcgacctctgaacaaagggacagcacaaatgacagccccatcataacgagggaggaagatacatcattctgcccgatcgccaaaagagtcgatgttttaatatacgtctgcatcgctgctgcgacaaatgcgccgatgatcaaatattttccgactgagaaaaactcgtcaactgcatggcggagcgtcccgccgagcttttgcaggaaagactggctctcatggacatggtggtgatgtccgtgcgtcccgttttcgatcagctgattccctttaaattgataagagatgatcagcccggcaatgagagacaccgcaatcgccaacccgccccggtagaacacgacatcccatttgtttccgaaagcgatgaatgtcgagaataatacaatcggattgatgatcggggccgtcagcatgaaggcgaccgccgcatgaagcggcactccctttaaaagcagcctgcgggcaatcggaacgatgccgcactcgcaagccggaaacaataccccggcaaatgttcctgacaaaacggcgagaaatcggtttttcggaatgattttcgccatcatctcctccgtcacaaacatttgaatcaaacctgatataaaaaccccgatcaagacgaacggaatcgcttctattaatatactgataaatattgagttcagctgcagaaaggattgtgaagccacaaaaaaacctccgcgcaaatccatatttttagtttcaatctagcattataacataaattgaaaaaagcggttttgtgtggcgggggtcagataatgggaggcgcatgagtaacagaatcaatacacagccttgaaagggaatgttatgataagaatattcaaaaaatgaaaagaagaggggaaagaaaagatgcagcagccttatgatatgccgcttgaacagctttatcagtataaacctgaacggacggcaccggccgattttaaagagttctggaagggttcattggaggaattggcaaatgaaaaagcgggaccgcagcttgaaccgcatgaatatccggctgacggggtaaaagtctactggcttacatacagaagcatcgggggagcgcgaattaaaggctggtacgcagtacccgaccgccaagggcctcatcctgcgatcgtcaaataccacggctataacgcaagctatgacggagacattcacgatattgtcaattgggctcttcacggctatgcggcattcggtatgctggtccgcggacagaacagcagtgaagatacagagatctctcatcacggacatgtacccggctggatgacaaaaggaatcctcgatccgaaaacatattactacagaggggtctatttagatgccgtacgagcagtcgaagtggtcagcggttttgctgaagtcgatgaaaagcggatcggggtgatcggggcaagccaaggaggcgggctggccgtcgcggtttcggcgctgtccgatattccaaaagcagccgtgtcagaatacccttatttaagcaattttcaacgagcgatcgatacagcgatcgaccagccatatctcgaaatcaactcctttttcagaagaaacaccagtccggatattgagcaggcggccatgcataccctgtcttatttcgatgtcatgaaccttgcccaattggtcaaagcgaccgtactcatgtcgatcggactggttgacaccatcactccgccatccaccgtctttgcggcttacaatcacttggaaacggataaagaaataaaagtgtaccgttattttggacacgaatacatcccgccgttccaaaccgaaaagctggcgtttctgagaaagcatctgaaataaataaaagcgaacacccggtgaagccgggtttttttatgtcttgatttaagaatatatcgtattataagatgtaattagagagggtgatgaaagtgaatacggaacaaaccatagaagtgatgaatcagaactggacggatatttactaccatctgcacatgaaacatgatgatcaattgtctcaccaagcggttcggatgcttcagcatatcgaaaaaaaccgctttgtgaccattggccatttagcaagattgttggatgtctctcataatacggcatcagaacatgtgaaaagactaatacaaaaagggcttgtacagaaaaacagggacagcagcgatgaacgcaaagtctacgtcacgttaacgcctgaaggtgaagaagcagtgaaacggcatacgagacttaatccgaaaaaactgcaaaaggtgctggagcaattaaatgaggaagaagtcgaaatggttaaaacagcattttccttgttaagccgggaggcaaaatcatgtttttaatagtaaaaatcggggtttctgcaatattgattgccattataaccgagattgcacgaaaatcgcctgaaatgggcggaatgattgcggctttgccgcttgtcagtctgctgagtttattttggctgagtgtacaaggggaatctttaaagcatttaagccaatttgcgaaaggcgtgctatgggggtttccagccacagcggttcttcttttgatcgtggttttgagtttaaaagcatcattcccggttatcatttctgttgtatttggaatatgcggatggggcgggtgtttaatgctgcaaaaggctctcatccatgcaatattcgggtgaaaggcgggttgtcctttggtataaggagctgcctgtgctgccgcacaagcagcctaagaaggtccggcggggggatggaacggaataacattccggtccgagtctaccacgtataaagcctggagtagtaaatcatcctcgccggaaaaggagcgtcccggtatgctccgtccggcgggatggatgtcgacagaaatcggaaataattgctcccgagtatttttaagtttatcggataagtctggacggtttcaggagcgagttcgtaggagaatgcttgagctttagtttgactgatcatgaactcttgatattctccattttgaaagtaatataaatagccctttaaacgatgcgcttcctggttgaccaaagagatatacagaacttctcggccggatttttcaacggggtttcctgctttgtcagacaggtaaatcaatcccgtttgagatgcgcttccgctgtatatttgacagttaacgggttcaatataagcagggtgtgccggcagccggtcaggatgcggagcatgtgaaatcaattcaaaatagtagggcgctacatagtcggcatcccgattccatttgcaatcgcactcagcctttggatcgaacatgaaggtctgggtgatgatataaacgatatgtctgcccgcgggcacatgctggagcctgatgttgatttccttggacgaatgagcgggaacgatgaatggaaaggtttgcgagggccggtcatttccttcaaagaagacggatatatgaattcggtcttcctcattcgcatggttgcagtagacgtatgaggcttggaaatggccagatgaatcggtttgatagcttactttgtttctgtcgatcgtataaaggttttctgcgtgaaaatgagttgatctgaggaaatgaataataccgcctccgtttcacagtatagtaagccgccggagtacccggcagcttcatattattttttgatataaacctctgtccgcttttccaggaaatcctggagcaaagcgatccccgagcaaatggcccagtaaatcaaggcaactaaaatgtacatcgtcatatagtcgaattcccgtccgccgacgatttttgcctgctgaaacaattcaggcacggtgatcatggcggccagggaagacgctttaacgagatcaagcatcacgttcgcaagaggcgggagcgcaatcctaaccgattgagggacaatcacgtggcgcatcgtctgccagtaggagaatccgaccgattttgcagcgtcccactgccctctgtcaacggacgacagggccgagcggataatctcggcaatgtatgcggcgctgttgatgctgaagccgattaaggcagcagccaaagccgtaaattggattccgatataaggaaaaccgaaataaaggataaatagtatgacaaggatcggaacgcctctcataaacgagatatagattcttgccggccaacgaagcaaagcgagcccggacatgcgcccaagcgcgatgaaaaaaccgagaattaaaccggcaaacatgctcgcaaaagaaatgaaaagcgtattccatatgccttgcatcacataaggaaacgatttcgcagccaattctgcattaaaaatatactcccattgaatagagcccaatttaaatccctctatttattcacatcgacatcgatatagtcgatatcctgctttttcgaaacatcggcaccgccgaaaaactttttcgaaatctttttgattgtgccgtccttcagcatttcatcaatcgttttgtcgaattgttttttaagttcagtgtttccttttttcatgatcatgccttgctgatgcggatagtatttaagatcgggatgaattgtcagatccagatcaggcattgcggcgagcgcgagcttttgaaggtagtagtcgtttaagatgacgtcggttcttccattcgctacatcctttaaaaattgatcatttgtcgcgttgtcgtaaatgacttcctctgctccgtatttgcgtgcgatatccatgtaaactgtcgtagctgcaccagcggctttctttccttttaagtcctcaagcgtgtggatgcctgataagtcttttttgcggacgatagccgttccgaatgaatatttataaggcgtagagaacaaaaacttttctttgcggtcgtctgtcatcgtaatatcgttggcggcagcgtctacttgtccgctccccaccgcagtcagcatgccgtcaaagcccatttctttaaattcgacatccaggtcgagccgttcagccgcttcacggatgacttcaacttcgtagccggtcagcttgtccttgccggaatcagtgtcatgatatgaagtggggtaaagggttcctgaagtcgctaccacgatcttccctttttcctttatctcatcccaggccgtttttttgttttcagccttattttgagctgtgctgcatgcagctgttataagagcaagcgccaacacagttatcaacaatgtaatgcgcttatacgtatgcaatttattcacttaaaacaatcctcctattcctttagtcaagtaaaccatagcactgaagtagggattaggcaataagataattagtattgggaaaaaataaaatgattgattgtgcaacctgctttactttttaaggtgaaagatggaatcataaaggtattggcaaattgaaacataaggaggataagaaagatgaaaaatattttaatcatcaacgggcatgaagcctatccccatgcaagaggacagctcaatcacactatttttacagcgatggcggacaagctgagcgaaaaatatgaagtgaaaaaaacagtggtggcagacggctatcaaatcccggaggaacacgagaaattcaagtgggctgatgccgttatttatcagacgcctgtttactggttcagcgttcctgctttatttaaaaaatatattgatgaaatttatgagtacgggcttttttatcaagggtctgaagactacggaagaggcggactgtttaccgataaaaagtatatgttttcaaccacatggaacgcgccgaaggatgtattctccaaggcggggacattcttcgaaggtaaaagccttgatgaagcgctgtttcatttgcacaaaatgcaggaattcatcggcatgaagcctttaaaaacattctctgtccatgatgtaatcagcaatccgcaagtggatcaatatttagctgatctggacgcccatttaaaagaagtattttcgatttaagtaaagaggtttgtgcacaagcgcagacctctttttttcgttaccctccaagaaaacgtgatacagttgagtaaaagcaaagcagggggtgtccgcatgtttttaaaaaagctgactttacttcgggaaggagttccttcttatgcaaaatatccattttcaattcctgctattcaacatttaaaagaactgacgtttcaaaaaaacgtaacattttttgtcggggaaaacggatcgggcaaatcgacgctgcttgaagcaatcgcagataaatgcgaatttaacacagccggcgggggaagaaataacacatatgaagtgtacggctccggatcggctcttggagactatatcagattgtcgtggcttcccaaagtaacaaacggcttttttctgcgcgctgaatctttctatcattttgccactcatattgatgaagtggatatcacgggatttcgaagctacggaggcagatctcttcacgagcagtcgcacggcgaatcttttttatcgcttttcaagcatcgttttaaagaaaaggggatttatcttctagatgagcctgaagcggccttatctccggcaagacagctggcattcttgaaaatcattcatgatttgacgaaatccagccaggctcagtttatcatcgcttcccactcccccattttattagggtatccggaagccgaaatctttagttttgatggtgaacaaatcgctgaagtgaactatgaggatacggatcattacactttaaccaagtattttcttcagcaccgggaaaagcttttggcggagctgtttttagatgacgtttgatctgaaacgcgtttcataggatatgataaggagcatccggatcaaaatatgaaacaggagttgagctatatgattcatcagcgactacgcccatttccagatcatttcctatggggatcagcatctgcagcctaccagatcgaaggagcctggaatgaagacggcaaggggctttcggtttgggatgtgttcacaaagattcccggaaaaacgtttaaaggaagcaatggagacattgcggtcgaccattaccaccgttttaaagaagatgttgctttaatggctgagatggggttaaaagcataccgcttttcagtcagctggccgaggatttttccgcagggcaggggagaagccaatgaagcgggtttgagattttacgatgacttgattaatgagctccttgctcatgatattgaacctgttttgacgctttatcattgggatcttccccaggctttaatggatgaatacggcggctttgaatccagaagaattatagaggatttcaatgcgtattgcgttacgctctataagcggtatggaggcagggttaaatattgggtgtcccttaacgagcaaaattacaactttaatcacggctttatcacagcgatgcatcccccgggtgtgaaggatagaaaacgcttctatgaggctaaccatattgcatttctagcgaatgcaaaggcaatcgattcttttcgccggtatgttcccgatggaaaaatcggaccgagttttgcttattcgcctgcatatcccctctccagccgtccggatgatatcctcgccttcgagaatgccgaggaatttacaaactattggtggcttgatatgtactgccggggaacatatccggacatccctttaaagtatctgaaggaaaaaggctgggcgccgacaattgaagatggggatatggagcttttagcaaaaggaaaacccgattttgtcggtgtgaattattatcaaaccatcacatatgaaatgaatcctcttgacggggtatcggaaggaaagatgaatacgaccggccaaaagggaagcaatcaggaaacaggcatgccgggtttatacaaaacaaaaaggaaccctcatcttgagacatcgaattgggattgggccattgacccgatcggtctaagaatcggacttcgcaggatttccagccgctatgggcttccgcttttcataacggaaaacgggctgggggaattcgataaggttgaaaatgacggcacgattcatgatgactacagaattgcctacttgcgtgcgcaccttgaacaatgcagacaggctttaaacgacggagtcgatttaatcggctactgcagctggtcatttacagatttattgagctggctgaacggctaccagaaaagatacggtttcgtttatattaaccgtgatgaagagaatgtaaaggacttgaagagaattaaaaaagacagcttttactggtaccaaaacgtcattcagacaaacggggaagagctttaggaggggcgccggatgaaaccggcgcctttatccgttgttcaagcctgtttaaaatcgagaagataggtgatctgtgcagtgccgctgtgatcaggcattattgtatagcatgtcagctgataggcgccttgcggaatatcgcatgtcaatttcttggataggacgcttgcaatttctaccccgtcataaagcacttcgaaaggaacggtgacgcgcctgttgaaggagggcacctgtttttgggcattcaaacggacttctactgaagatgccgtgttttcgagagcttcaaacgagaccgcgtgctctcccgttgtatatcctcttttaatatcctcgtctgtccaatccataacgggcggctttccgcctttctgataaacggtaaactgatggtatgacatcgtcatttcttgtgcttcccactttttgatcaaagaccgtacccccagtgttaattaatcttgaaaagtactttcgtcccgtccggataatcgcttacctgattgcccacccaagatcctgctccacggttatcagacgggctgatatactcgacagaagcacctgttccgccttcttcgcacatggccatcggccactcgtcgcggtcatagcctgatttggaaggaacatctttcaatgaatcctttcggcgttcggcggctccgtccctgtcgatcgtacagatttcggagtgcccttttttgatagcctttcgaatgtgtgcgcctgtttcaggatagcggtccgaaggaaaaatcagcacttcatcgtagtttgagccgttttgccggcccgaaggctggtgttctgaagtgaaaaagtcgccagatacaataccgatgatcacgacggcgacggcgagcaaggtgatcagcaaagatttaatcttgtccattcttgttgtcctgctttcttatgttaaatcattcggccgcagtggaccggaagtaaatacaactttattatcgtaaaaatgatttgagaaataaaggggagattaataagtttttcctcttgaaatgctgagtttccgtctatcaaatcgctttttttaaaattttgccggtcgtttagaaagttttagaggttcaaaatttaaatttttcatatgaaagaaaaactttcaggccccctttatcaagcctttctgcgcgaatgatatgaaatacaagacagaaaaggagctgatcgagttgcttcgcaagctattgaaggcacttcaaaacggcaaaaaccgacgatacagcagcagcgattacggacggaaatcatacaaaaagtacagcagcagcgattataaaagaaaagggtacggtcatcgccattacaaaagaaagcacaagaaatttttcggcagcagctaaatcacgtgaaaacattgataagatggctgtttgaccgcccgctcaaaaaaggaaccgtcttggaggggagatatcgaatcaaccgtgtgctcgggatgggcaactacggcatcacatatcttgccgaagaacttggaagatccggtttccgcgtcatcaagcagcagagaaaaacaaaagcatggacatcagccggccggcggtctttcaaccgcgaggctgaaattttgcgggaattggatctgcctgccgcgccccgtctatatgaggtgcttcgagcggccggcgagcggtttatcgtaatggagtatattgaaggaaaaacgtttgaagatttgctcttttatgatgggcgtgtctttgatgaacagcaaacgatcagcatattgaaggaggtgcttcacagcgtttcacttcttcacagccgggggattattcaccgggacttgaggatcccaaatttgattgtgaatcgaggaacgatccgcatcatagatttcggactggcatgccgcctgactgagagagaacgcgttgataaccggcacccggaaaaaaagctgatgcgtgcagtttcagtcaaaagtgacttttatgcgttagggcattttgcattgtttctcctgtactccggttttaccccgtccgacgaggaagaaaaatgctgggaagaagagctcagcatatcgtctgggcttaaatctgttctgcggaagatgctgcagattgatctcccgtatgagcgtgcagaagacattatcggcgatttgatttcctgtacggcggaaaagaagaagctgccgttttaacggcagccctttttccctgctatttcattttgacttcaccgatgagctgatgcaaatcttcagccagtttggagagttcatttgcagaggcggtgacttcttccatagccgcaaactgctcttctgtcagacctgcgacttgttgtgaataatcagatgtttcctgaacttcttttgagattgctgtaaatgatgttgtgatgttttgaatgctttgcgatatatgccgggcgtcggaagacaagtcggaaattcttacgctgaactcttccattaagccgtcaatagattcaaatgtccttttgttcttttcgatcattttgacgccgttgaccgcttccgttttcactgtcatgattgaatcggttgtggttgcgatttctgattgaatccctgaaaagaggtgggagatctgattggctgattgctgcgactgttcggcaagacggcgaacttcttccgcaacgacggcgaatccttttccgtgttctcctgctcttgcagcttctattgaagcgttcaaagcgagcaggttggtttgatcggcaatctccgtgatcgcttttgaaatgctgccgatttcatatgatcttgtattttaagcatttcaatgatttctccgctttcatggaccgattgatgcatcgtgtgaatttgccgcatcgtttcggagatatcttttgccccctgttttgcttttttgcgggcgtattggctcttttcattcaggatcgcagcgttttctgatatgttttgaatatcggcggaaacttgttcaacggcttgtttgctgcctgctatccccgatgtctgcatttccgatgaacttgcgatatgctggacggcttcggtgattttctcagaagcgaggcttgtttcttcagctccagatgtcagctgatcagaagcggcagctacactgtgcgacgactgtgaaattttttgcatcagccggtttaggctgtcattcatttgattgaaatgatgtgacaagtcgcccagttcatctgtcgaatcatcctggatctcggttgtcaaattgccgctgcccgcctgttcaaaagcatgagtcagcattctgagccttccgcctatccttttggtgaaaatgaggacaagcaaaatggagatgatgattgaagcagtcagaacgatagcaaaaattttcaggaacgattgaagagtgcttgtgatcatatcctggtcggcccctgtataaaagatgccgataacttcaccgctcttgtctttgatcggcatatatgccgtttgatatgtttttcccgctacatctgcttttccataaaagttttttccttcttttaaaaccgcatttgctacctccgaagacactttcgttccgacagcgcgttttccgtctaccgtcacatttgtagatacgcgcgtgtcatattgaaagatggtgacagtgtctttcgtatcattgccgatttggtcgacgagttcttcatttccgttgataagggtcgaacctttgtagagcctgtcttctttgacttcccaatcaccttcaagagattcattcaaataacggtagctcaatttcaaatcgcttttggctttctctgtcgccatctgttctaactcttttgaaagctctttgataatgaaaatcccgagtgctgacgaaaagatcagaataacggctaacacgagaagattaattttcgtccccaatttcagcttaaatcgctttcatgtttcacctgtatacaatatcggttaaaacggaggcgtgttgacaaaatgaaaaagaaaaccccgcttgtgaaaacggggttttggacaatctgaaagcctaaagttcctctgctttttcggcttttcctgtttcatactgtttttgtttatttgcgatgtagcttcttgcctcttgatgcatgcgatgtttcattttatagacttcactgttttgatagatatgtgaattgtagtttaacggagacgcatttttcccttttcctgttgcgtcgattaaggcggaatagtcggtctggatcatttgctgaatatgttcagaggccgagtattctcttttgagcagtccatcaagatcttcgacagccttgattgtgtcttttctgttttggtttgcagcgtcaagctgctgtttgatttcatcggatgagaacggctgtagcgatattaaatcatctatctgtcctaaaatattcgacagctcttgctgctgtgcggagaccatgttttgagagtgaatgtggacatttgcaagctcctgttcaagaaattgaacatcaacgaacgtatcctctgaaagtccggcattttcggcagcagaagatacaccattcagaaactgaatctgcatatcggttaaatccagccagccgtctacgactcctgataggtctctgtaaaacgctttaatggcatcggcgccttttccttgaaactcatcaagttctgcgacgctgtttaacgctttttttaagctgacgagctgttctctcaaatttttatattcatcagatctttgcttcatagctgaaattagggtttccgcttcgtagactttcattggaaatctgcccttcctgcgacttatatagtacagagtgtaccactttgccacagggaattgggcaataaatcctgaatatccatgaaaatgaatctttatgatcaaatctgcgagacgtttaggttttttgtcgcaacagatgatctttgctttagtagttaattagtcctctttatgacaggaatgtgtcgatggaccgaagaaaagctgaacaccaaaaatgtgaaatactgtgaacaacacaattgaaaatgtgattttatggtatcttaaaataaaatattaaacaaaaaagacttggaatatctactttctcatgcttgattagtatgatagtaaaatattttaaaaaaaggatatttttaaaaggggagatcgggattgaatgaagaaggttaccggcttggaattgatattggaggaacttttaccgatcttacattgttaaatccggcggacggaagcatgaccgcagttaaaacgccgaccgttcccgaagatccggcccgaggaatcatcaacggcttggctctcttgaaaactcggggtgtccagccttcagaaattcatcactttgtacacggcatgacaatcggtttgaacacattattacaacgcaaaggggctgatattgctttattcgtaaccgaaggtttccgtgatattctttcgcttcagcgtctccggcttccggtaccctacgattttagatctagaatgccggagcccctcattcctcggaaaaacgtgtttcccattcaagaaagaatgctttatgacggctctgaaaagctgccgcttcatatggaagatatcgatgaggcggttggacaagctttaagaaaaggcttaaaaggaatcgttgtttcttttttgcacagctatcggaatccgctccatgaacgccaggctgccgaacggatcaggcaaatagcgcccgagcttgaggtggcaacgtctgcggagctttggccgcaaatgagagaatacgaacgaacggttatgtccgtcgcgaatctatacatcaaaccgaatatccatcactactttggaacgctgaaagagaggcttgtccaggaaggaatatcggcgcagccgtttatcacccagtccaacggaggactgatggacattgaatcggctgccgaggcacctgtcaaaacgcttttttccggaccggcagcgggggtcataggatccatcagaacggcggaagccgccggcgaggccaatatcatcacctttgatgtcggaggaaccagcgcagatatttcgattgttgaaaaaggagagccgacctttacccagtcaaatcaaatctcgggatttccgattgcgattccatctgtagcaatgtattcgatcggtgccggcggaggatcggtggcatggattgacagcggcggtctcttgaaagtagggccggagtcagttggctctgatccggggccggcctgttacggaaaaggaacaaaggccgcacttacagatgcgtttcttatatgtcattatttaaacccaaacaggtttgcagcaggaaatatgaaactgtaccgggaaagagccgaaaaagcgctcctcccggttgccgagtatttaggcacagatgtggagcaagccgcggataagatgattcaagttgcgcttgccaatatgtacacggaactaagcaatgtcatggagcaacacgggtttgacccgcgtgaattcagccttatggcttttggaggcgcaggcccggttactgctaattttttggctgaggaaattcaggccaaaaatgtgctgatcccgccgcatccgggaactctatcggctttgggcgcactgacggctgattttatctacgatgctgtatgttcaagacaggtgctgcttgagcaaataaaaacggctgagttaaaagtggagtttatgaggctgcaagaacaggcggaaacatggctgcggaaacaacgggcggacatggtgactgaagcctctcttctttacttgcttgatgcccgttataaaggtcaggcgtatgaaattgagctccctgtttcaccggaatggctggaaggcgaaagtacgagtgaaatcgcagactcctttcatctcttacatgggaagcaatatggacacagcgatgggaaagcaagcattgaattgatgaatatgcgcgtccgcattataggcaagacgctgaaaccgccaggcggaaaaggatgtcaaagtaatctgcccgaagctgaacctgtcagccaaagaaagatcatcatgaaaggcggtacatatcaagcctccgtataccgccgtccagatttaaggagcgggcagagaataaatgggccggccattgttgagcaggacgatacaacgacgctgattttgccaaattggagcgggaaaaccgatcatgccggaaatttgatcattgaacggaaggagagctgaccatgcgcacagatcctgcccggctggaaatgatgagaagctactttaacgcgatagccgcgggaatggggcacgttattgaacggacgtcctttaccacatttgtaaaagaatcggctgatttcgctactgcgcttgcgacgccggaaggggagtttttcgtttatccgaaaacggtcggcgtcacgatttttttagggctttcattaaaacgggtcatcgaagaaagcggcccatttgaaccgggagatattatcctcacaaacgatccttatacaacggacggattggcgacccacttgcctgatattcatgtggtgaagccgattttcttggagggcgagataatcagttacgcgtggtgctttgtccattgcagcgatgtcggcggccttgtcccggcaagcatttcgccgaccgcgacagacatccatcaggaaggcctgagaataccgccggcaaggatttacaaaaaggggagagaaaatcgcgatatattgaaggttttgcgggcaaacagcagggttcccgacttaaatgaaggggatattcatgcgatggtggccgcggtcaatacggcggagaatcgattgacagaaatggtcggaaagtttggaaaagaagcggtccaacaaggaatggatgatttgctcgaacaagccgcgatgagagccggacgggtaatcagcaggattccggaaggttcatacagtttttcagattatcttgatgacgatatgatttctgacgttccgatccgcttggctgttacggcaaacgtctcgggaggggagatcacattggacttttcagactgtgatcctcaggtgaagacagcatttaaccttgtcaccaatggaagcaaacattcatttctatataagggcctgatcaactatatcataagtgaagacccgtatattccgattaacggggggctgacacggccgatccaagttatcgctccaaagggtacgctggttcatccggaatatcctgcggcggtcggcattcgtcattcgatcacgatgagactttataatgctgtactgggcgctttggcaaaggcgcttccgaaagccgtgcctgcagcaggcgccggtcagtcagcgattgtcgtactgtcggttcccgatgaatcaactggcagcaggaagatgtcggtggtcgaaccgatgggaggcggaggaggcggccagcatgacatggacggagcagatggaattgaccatgcctccggatttttgaaaaatacgccgattgaaagccttgaacagcacatcgacatccatgttcgccgctatgaattgatcaaaaatacagccggagccggttttcacaggggaggccatgcaatcgagctggagtttgaagcggcggcaccagaatcaattgtgaccgcaagagggatggagaggatgcgttttcatccgtgggggctcgccgggggaacggcaggagcgctcgggcgggtgcgcctttatccggatcagcctcaggagaaaacgatgtcgaagatcgatgttctaaagctcaataaaggggatgttatcagcattcattcaccaggcggcggaggctggggaaatcccttccgccgggaagctgaatcgattttaggagaagttgaagcgggcttgctgagcccggaagcggcatatcatcaatacggcgttgctgtaaaagaaaacggcgctggctccttcattattgatctggaagaaacagctgaaatcagaaaaaagaaagcaggcgaacatcggaaacaatgggatttcggaatcgccagagaagaatacgaacggtgctggacagaagaagccagcagcacattggcccggcttctgcgacagcttccggctcatcaaaggtcacatgttaaacatttagtccaccgttatttctcaaaagaacataacggtccgatcagtaaaagcgaagttgcggccgctgtggaaaaactggctggaaaaaataacacgggaatggtgagatgacaatgaaaagtaaaatttctgctttatttattctgtctcttgcagcggtgctcctcctttcgggatgcggcggaaacggaagtcaggaaagcaaacaatcagatacagtcgttatcggcgtctatgggggcgattgggaaaaacatatcaagccgagcctcgaatcttttgaaaaagaaacaggactgaaggtcaaagttgtcgcagggacagactctgagtggttcacaaaactcaaggcatcgaatggcagaaatgctccctatgatctcttaattctgcagccggacacgattcacagagcgcagtcggcgggattgctggcaccgatcgatcaggaaaaggttccgaatgtccgcgatctgtaccactctgttcagaaacgcttcaccgatgatggaaagcagtatgcggccggtttcagtatgggacagcttggaattgtctaccgaaaggatcttgtaccacaggagcctaagcgctggacggatctttggaacagcagctataaaggtcatgtcgccatatcatcgccggcttattcggcggggcttcagttttttgtaggattaatcaatgcccagggcggcctggagtcaaacgggaaagacgtggataaagcgttcaacagcttggctgatttaaagaacaacataacggcctatcccgataatccaggctcgatacaaacgcttctggaacgtggggatgcatgggttgttccgttttgggacggccgcgctttttctttgcaggatgcaggtcttgacctgggatttgcatatcccgaggaaggtgcagtcgcagcagttgcaagctgggctttaatgaaaggaagtcctaatcaggataatgcgtacaagctgttaaatcatctgctcagtccagaagtgcaaggagattttgccgatagaacgttttacggcatggccaataaaaaagtgaaatacagcgataaattaaaagggaagatcaaagtaggggaggattattacaggaatttaaaatgggttgactatgaagtcgcggcaaaagatctaggcgattggacaaatcgctggaatcaagtacttggcggaaaataggtgacaaacatgagcgcaattcagattaggcatgtcagccggcatttcggaaacaccatcgcattggaagacgtacagcttgaagtcaaagaaggggagtttttctccctccttggtccgagcggctgcggaaagtcaacgctcctgaatattattgccgggttccttgaaccgacgtcaggttttgtatatataggaggacgagatgtaactgatttgccgccatacgaccgacatatcggaatggtttttcaggattatgctttattcccgcatctcagcgtttttgacaatgttgcatacggcttgaaagtccgaaaatggccccgccgcaagattgaagaacgggtgatggaatgcctcgctcttgtcaggcttgaagcgtttgctaatcgcatgccccatcagctgagcgggggtcagcagcagcgggtggcgattgcccgggcattggccgttcagccgtctgtgcttttgctagacgagccgctgagcaacctggatgcgaaacttcgaaaagaaatgcagacggagctgcgcagcatccaaaagcgcgtcggcattacaacgattttagtgacgcacgaccaggaggaggctttaagcttatcggacaggattggaattctcggatgcgggaggcttcagcagctcggcactccgttggacgtgtaccgcacgcctgccaatcaatttgtggccgaatttatcggacaggtcaatttactgaaagcgcgtgcgtcgaagatacagccttcatcgggcggctatggatacgaaacggtcgatttcgaagtgtatgaaggcgttccgctgacatttgaaatcaaccaggaactctcaaaaaaaacttctgtattgttcatggtgcggcctgagaggatctcagtctccttcgagaagcaaaagaacaggctgattgaaatgcctgcaacaattaccgaagtcagttacgccgggcatgatctcaggctgaaagccgctgttttcaaaggagaatggatcattcaggcgcccgatcctcaattccctagattgccgaaggcgggagatcaagtgtatctttctttggagccgggcgattttgttccgctggatgttaaggaggatgcagatgagggctgttgaacaaaaacggttttattggtttttgctagttcctgtccttttatttctcggtgtttttcttgttttgccgcttgttctgctgctgttattaagtttcagagacgtggacgctatgatgaatacgctcgatacgtatagtttttctcaatatgtcgaggtgttctcttcagacgtttatttgaaaacaatcggtataacaatttggacggcgttgaagaccactgttttatgccttgtgatggcgtatccggcggcatatttactcgttaaggcgccaaccggcaggctgcgggctttgttttacattttgcttgtttcccctttattgaccagtgttgtcattcggacgttttcctggattgtgctgctttcgcaaaacgggatcgtcaacgaggcgcttatcagtatgaagatgattgaaaagcccctgccgcttttatggaatatgaacgcagtcatcattgcatatgtccaggttatgctgccgtttgcagtactgccgcttgccagttctttaagcgaagtgaaacctgatcttaaatttgcttcgatgagccttggagcgggcaggctgcggacattttttttcgttaccttgccgatgacggttccgggattgctgacaggagcaatgatcgtgttttcgctttctgccggaagctatattacgcctcttctcgtcgggggaaggatgcagccgctcctgccgttgtccatctatcagcaggtcatgcaagtctttcatcttcctcttgcagccgcaatgtcgattactttattagccgttgtcagcgtggttattggaatccttggcattttccaaaagcgttgggaggcgagaataaatgggtaggcgattgcgacgtatgcgcaggggaaaatggattgatgcgtgtgtttggacagcgggtttattggtatacttctttttggcgctgcccgtcttcgtgatcatactgtcggcattcagcccggacgaatatccgaagttcccgccatcaggcatctcgctgcgctggtttgccggagttttcagcagcagcggctggatggaatcgatttgggtcagctttatgctgcttctcgttgtaacgcctcttgcggtgatccttggaacagttgcagcctatgcattggcgcggctgaactttccgggaaaacaggcgattcaggcttttgttttatcgccgttgatgattccccaaatcgcattaggcgtatcatttctctatttattgacaatgattggggtaaacggcacgtttgccgggctggccgccgggcatatgctgatcagccttccgtatgtcgttcggacggtcggagtcagcatggcaaacgtggatcagaagcttgaactggcatccatgaatctcggcgcaggtccctggcataccttttttcatgtcatcttgccgcttattaaaccgggaatcattgcgggagccgtttttgcctctgtaacgtcattcggagaaatatcaatcagtctgtttgtttcttcaccggctgtcacgcctgtaccggttcgtacattcagctatattgaccagacatttgatccgagcgttcatgcgatttcggttatttttatcacggtttcagtgattgcgctgatcatcatcgaacggacgatcgggctctcaaaaaccatgtagcaggcgaaactcagcctgcttttttgtatggagcatcggaagtatttcaagataccgttcagaatgagacagttcagcaaatttaacattctgcttcaatgttttcgcaagccggtttgtcttttctcgtcagtttaaacggcctggtaaaagaaacgttttaattgaatgaacattgtaaaaggaagcgccgaagctttaacaggccttcatgatttatttatgaagtccatgctgtttttttaatattttaatatactctttatctaagatttggaattttttgcgggtttaaacgatttttttcgttttcccgcatatttttttgtcaatttcgggatcgcgcattaacattcatgtacaacattcggtatcccgcatgaaacttttcacctatttttcggtgaaaaaaacaaaattttcatttaaagtgaactgtgagcagaaaatgaatttatatcaagaaaagcagataaaggcaaacctgcggaaacgcagggacgcaaagccatggcctaaggtgctgacggtgctacggttgacaggttgccgaataaacagggagttcgcccgtttttattcgggcgggctcttttctttttatttccaatataatgttttattggaaacgacaaatctgtgacagcgtttttcgctcatcgcaaaaccgcaacattgcattgcggcttggctgttcgcatcgtcatacataacaagagataaaggaggaataaagaatgggaaacacattttacccgctgacacatgctcaaaggcgaatttggtacacggaaaagttctatcccggtacaagtgtttcaaatttgagcggctttggaaaattaaaatctgcatccggaatcgattccgggttattgactgaagcgattcgcaagtttgttcgtacgaatgacacgatgcgattcaggctgatgtttgaaggagaggatgagccgaagcagtatatagcggaagacgaacctttccaaattgaatattttgatgcttcagaaagcggaggagcagacggcgttcttaaatggggacaagctgaggcgcgccggcccctgcctttgtatgacagtccgctgtttaaatttgccgttgttcgcattagtgaagaagaaagctggttttttgcaaaagttcatcatatcatttccgacggcatttctatgacgatcctaggcaaccggattacagatatttatttgaagcttgccaaaggggaaaccgaccttgaacctgtacagtcatcatttacggaacatatccagagcgaattggagtatgaaaattcgaagcgtttccagaaggataaagcatattggaacgcacaatatgaagcgattccggagcccgtatcgttaaaagcgagcgatacgtatcagatccaattggatgcagcccgcttttcaaaagagatttcccctgacctgtataaaaaaattcaaacgtattgtaatgaacacaacatcagtgtactctccctgttcctatccattctgcacatctatatgcaccgggtaaccggacaaaaagacgtcgttctcggaacatttatgggtaaccggacaaatgcaaaagaaaaacagatgctcgggatgtttgtgtcgacgattccgatgaaagcctccattgaagtacaccaagactttagtgcatttgtgcaggaaagaatgaaggaccagctgaaaatcattcggcatcaaaagtatccgtacaatctgctgattaatgatttgcgggaaagacagccgcatgtcagcaaattgttcgccgtctcactggaatatcaggttatgcaatggcagcaaaaagaaacggtgtcgtttcttaccgagccgattttcagcggcagtgaagtaaacgatatttccattcatgtgaaagagagatgggataccgggacgcttgcgattgattttgattacagggaggagctttttacttcggaagaaatggccgtgttatatgaacggctgatgacgctgcttgaagatgccctgctgtctccgcaaaaaacaatcgctgaactggagattgttcccgcttttgaaaaagagcggctgttaaagcgtgcatcaagccaaaccattgcatatgacaagaacatgaccctgcacggtttatttgaacaaaaagcagccgatcatcccgaaaaaacagcggttgtatatgaaggacaaaaactttcgtaccgggagttgaatgaacaatcgagccgcttggcaatggcgcttcggagaagaggcatcgggcctgatgctccggctgcgatagtgatggagcggtcagagcgggtcatcacggcgatgctgggcgttttgaaagccggcggagcttatgtaccgatcgatcctggatttccggaagaaagaatccgttttatgctggaggattcaaaggcgaaagcggttatcacagacagcgggctgacttttgaaacggctgaaacggtgcagttcagcgaagcgctttctgaatcgcgggaaaacggctatccgtcttcagcggcaggcgccgggcaccttgcatacatcatttatacttccggtacaacgggccgtccaaaaggcgtcatgattgaacacaggcaggtccaccaccttgtcagaggacttcaacaggccgttggtacatacgatcaggatgatttgaaactggcgcttctggctccatttcattttgatgcttccgttcagcagatttttacgtctctattgctcgggcaaacgttgtacatcgtaccgaaaaagacggtttccgacggacgcgctttatcggattattaccgccggcatcaaatcgatgtgacagacggtacaccggcacatttgcagcttttggctgcggctgatgatctttcaggcgtcaaactgaggcatatgcttgttggaggagaggctttatcaagggttgcgacggaaaggctgcttcagttatttgcagaaacagctgaatccgtgcctgctgttacgaatgtttacggaccgacggaaacttgtgtggatgcctcttcttttacgattacaaaccgcacagatcttcaatacgatacggcctatgtaccgattggccggccgataggaaataaccgtttttatattttggatgaaaacggcgcactccttcctgatggcgtcgaaggggaattgtatattgcaggagacggagtcgggcgaggctatttgaacttgcctgacatgaccagagacaggttcttgaaagacccgtttgtatccggaggtctcatgtatcgaacaggggatactgcacgttggcttcctgacggtacagttgattttatcggccgaagagacgatcaagtgaaaatccgcggcttccggatcgagcttggcgagatagagtcggtgctgcaaggagcccctgctgtcgaaaaagcagttgtcctcgcgcggcatgaaaccggcggcagccttgaggtttgcgcttatgtcgttccgaaacaaggcggaaagattcacattcagggactgagggagcacttatccaaacacctgcctgattatatgatcccttcctgctttgtcgagcttaatgaaataccgctgacggcaagcggaaaagtcgaccggaaagcgctgcttcgccatgaggtgtctgtcagcgggactgcagaatatgcggcgccgagaaatgaatgtgaagaaaaaatggtgggtatatggcaggaagtgctcggagctgaacaagtcggaatccacgaccagttttttgatctgggcggccactctctcaaagcgatgaccatgctggcaaaaattcataaagctttcggagtcgaagttccgttgcaagtcctatttgaaaagccgacagtagcggcgctgagcggctttgtttctgaagccgagaaagacggattcgcggtaattgaaccggcgccggaaagtgacgattatcctctttcattggcgcagcagcgaatctatatcgtcagccagctggagggtgccggagtcggctacaatatgccggccgcggcgatgcttgaaggcactcttgactctgggcgccttgaagctgcttttcaaaaactgattgataggcatgaggcgctgcgtacttcgtttacagttgtggatggcgagccgaggcagaccgttcatcaaagggttcagttcaagattgagaaggttaaggcggaaggcaagcagatcgaacaaatcgcgaaatcatttgtccgccgctttgatctcgccaaagctccgctgatgagagcgggtctcgtcagccttgcagacggcagacatctgctgttgttcgatatgcatcatctcgtatctgacggcgtgtcgatttcgatcatattgaatgaactggccgcgctgtataacggggaggaattgccggagctgcgtttgcattacaaagattatgccttctggcaaagggcgcaggcacaagaaggctttcaaaaagaagaggcctattggaaaagcatgtttgccggcgagcttcccgtactgcagctgatgacggacgagccgaggccgcctgttcaaagctttgaaggagacagggtatccgcagtcctgccaaaagacctgaaagaaaaattagccgtgctggcagagcaaaacggcgcgacattgtacatggtcatgctgtctgcgtacaacatgcttcttgcaaagtactccgggcaggaagatgtgatcgtcgggacgccggcggccggccgcagacattccgatctggaaggaatcatcggcatgtttgtcaatacgctggcgatccgttcaaaagtggacccgggcagaacgttcgcagacttcctgaatgatgtaaagaaaacggtaatcgatgcttttgagcatcaggattatccgtttgagcggcttgcggagaagtttggcgcatcgcgcgatttaagccgtcatcccatctttgacacgatgtttattttgcagaatgcatgggaagacattccgctgctcggcgatttgcacctctcgatttatgaaacgaacttcaatattgcaaaattcgacttgacgctgcaggcaaaagaagagcatggagaattgattctcgatttggattacagcacgaagctgtttaaaaaagatacggctgaaaggatgctgaaagcatacttgaaccttctggaggacatggcggctgatccgatgctcaggatcggcgagtacagccttttgacagaagaagaaacgaatcgccagctcgtcgcgttcaaccccgcgacaagcgattatccgcgggagaaaacgatcgttcagctattcgaggaacaggctgcagaaagaggcggttatcccgccctgcaatttgaagacaaagtatggtcatatgatgagctcaatcggaaagcgaaccaattggcaaggcgcctccgcaaaagtggcgtgcaagccggcacgacggcggccattcttacggccaggtcggctgaaatggtcatcggcattctcgctgtgctgaaagccggcggggcttatgtgccgatcgatcccgatcatccggaaaagcgtgtgcaacatttcttcaaggacagcggagcggcggttcttttaacgcaaaaggcgatgaagccgctcgctgaggcggcggaatttggcggcgacatcctatttgttgaggatgaaaacctttatatgggagatgcgtctgatttgcgccttccgatttctccggaagcaatggcaaatctaacgtacacatctggaacgacagggacgccgaagggcaatatggtctctcaccggaatattttgcgtactgtaaaaaacgcgaattacttggaagtgatggaatccgatatcgttctttcgatttcaaattatgtgttcgacgcctttatgtttgatgtgttcggttcattgctgaacggcgccaagctggtgatagctccaaaagacacgattcttgatatgagccggctcgcacatgtactcgaaaaagaaaagattacgattttaatgatcacgaccgcattattcaatctgctgacagacatgcggccggacagtttgaagggactccgcagggttctgttcggcggcgaacgtgcatctgtcgatcatgtcagaagagccctgaagacagttggcagagggcggctgcttcatatgtacggtccgtctgagagcacggtctttacaacctaccatccagtcaatgaagtgccggacgatgcgcaggctataccgatcggaaagcctgtcagcaatacggaggttctgattcttgattcattcggcaatgtacagccggcaggggttgcgggagaattatgcgtcggcggagacggccttgtccgcggctattttaaccgccctgaactgacggctgaaaagtttacggcgcatccgttcaaaaccggcgaaaagatttaccggacgggtgatatggcgagatggcttgccgacggatgcctcgaatttatcggtcggattgatcatcaggtcaaaattcgcggacagagaatcgagctgggcgaaatcgagcatcatctcctaacgcatgacatggttcaggaagccgctgttcttgctgttgacaccggggcgggagatcaaatgatctgtgcatactttacggctgatcaggagctttcgagccaagagcttcgccgacatgcggcagaaggtctgccaggctatatgatcccgtctgtgtttatgcagcttgatgagcttccgctcacaggcaatggaaagatcgacagaagggcgctgcctgaaccggatatcgcgcaggccgcgcaaaaggaatatacggcgccaaggagcggcacagaagcgcagcttgccgatctttggcaggaggtgctcaatgtaccgaaaatcggtgtgcatgacaatttttttgaactcggcggacactctttactcggaatgacgctcatcgcccgcatccagcaagagatgaatgttgacctgcagctgaaagacttgttccaggcgccgacaatcgaaagcctggcccaggcggcggcaaaatctgagaaaaaatctgccgtttatattgaagcggcgccggaccgggaaacgtaccccgtttcgtcggcgcaaaaacggctgtacgttcttcagcagattgaaggcgctgagaaaagctataacatgccggccgttctccaacttgaaggaaagcttgacctgaagcgcctggagtctgccgcgcaaatgctgatcaagcgccatgaagcgttccgcacgacgtttgaaatcaggaacggcgaacctgttcagcggatttgggaagctgcggaattgaccattgatgtcatcgatgcagatgaacaagaagcggaaaagctgattaaagagttcatcaggccgtttgatttaacaaaggctccgttatttagaatgagcatcatacgtgtcacggaagaaaaacatcttttgcttgtcgatatgcatcatatcatttcagacggcgcttccgtcagcgtgctgatcgatgagatgacaaggctttatgcgggagaggcgcttgaaccgctgaggattcagtataaagactatgctgtatggcagcagcacttgctcactgaacggcacaaaatgcaggaggaatactggctcaaggagcttgacggcgaactgcctgttttgacgctcccgacagactatccgcgtccttctgttcaaacgtttgaaggaagccgtatcagcttttctctgaaaccggagcttgtccagcagctcagaagactggccaaggaaacggaaagcactttatacatggtgctcgctgcctcatacagtacgtttttatcgaaactgagcggacagagcgaggtcattttcggctctccggctgccgggcggccgcatgcagatttgagccgtatcatcggcatgtttgtcaatacgcttgcgataagaacgcgtcctgaaggagacaagccgttttctgcattccttgaggaagtaaaagaaacgacgctcggcgcatttgagcatcaagattacccgtttgaagaactgatcgagaagctgaacatccagcgcgacatgagccgaaacccgttatttgatgccgtcttttcaatgcaaaatgccgatttgaaagacttgtcaatggaaggagtcacacttaaaccgtatgattttgcccatcagactgcgaaatttgatctgacgttgacagcggcggaagaagacggacttctcgtttttgaaatggaatacaatacagctctctttaagcgcgaatcgatcaaacgctggagcgggtactgggtcaacctgctcgaagcggttgccgaaaccccggatgcaagtctttcagacctttcgcttctggatgaagcggaaaaacggcggatcgtccaaaagtggaatgagacgaagctcgctgtgccgcaggacaaaacggtccatgagctgttcgaagcgcaagtcctccgcacgcctgaccgcggggcagcggtgtacaacggcgtgaagtggacgtacaaagagctgaatgcgcgcgccaaccgtctggcccgcctgctgattgaaaaaggagccggtcctgagcagcgggtcggaatcatggtgaagccttcgctggaaatggcggccggcgtacttgcgattttgaaagcgggagcggcctatgtaccgatcgatcccggctatccggccgagcggatcggatacgtactgaaagacagcggtgcagaactgcttctgacgcaaacaaacttagccgtacctgaagaattcagcggtgaaacgcttcttctcgattcgatgctgagcgaagaaatcacaaatgatgatgaagtgaacccgcaggcaggtacacagccaaacaacctggcatacttgatttacacatcgggcacgacaggccagccgaaaggcgtcatggtcgaacatcaatcgctcgtgaacttgtgctattggcataacgatgcattcgcggtcaccgaacaggacaaaagcgcgaaatatgccggcttcggctttgacgcttccgtctgggagatgttcccgtactggatcgccggagcggagcttcatatcattgatgaagcgatccggatggacattacgcgtttgaatgaatatttcgaagagaacggaataacgatcacgttcctgccgacacagctgtgcgaacagttcatggagctcgacaaccagtcgctgcgcgtgctgcttacgggcggagacaagctgaagcggatcgaaaaacggaactacacgctcgtcaacaactatgggccgacggaaaacacagtcgttgcgacgagcacggcaatcgatcctgatgaaggcatgctttcgatcggaaagccgattgccaatacgcgggcgtatgtgcttggacaaaacaacgaagttcagcctgtcggcgtcgctggcgagctgtgcatcgccggccgcgggcttgcgcgcggctatctgaacaagccggaggaaacggcgaagcgttttacggaagacccgtttgtgccgggcgagcgcatgtaccggacaggggatgcggtcaaatggctggaagacgggcggcttgagtacatcggccggatcgaccagcaggtgaaaatccgcggcttccggatcgagctttctgaaattgaagtccagctcgcgcggctctctgaagttcaggaagcagtcgtcaccgacatcgaagacgcctacggcaacaaagcgctgtgcggctatgtcgttgcggacgaacagcttgatacagaaagcctcgcccgtaagctggggcagacgcttccggactacatggtaccggcgtattgggtgcagcttgatgagcttccggttacggcgaacggaaaagtcgaccgaagggcgctgcctcagcctgacgtcgaagcgcagacagccgaatacaaagcgccgcgcacagaaacggaacagctgttggcggacatttggcaggatgttctcggcatagaccgaatcggagtcacggacaatttcttcgcgctcggcggggactcgatcaaaggaattcaaatggcaagccgccttcagcagcacggttggaagctggagatgaaggacttgtttcagcacccgacgatcggggagctcagtgcttatgttcaagcggctgacgatcagccgatcgatcagaaccctgtcgaaggcgaagtcacactgacgccgatccagcgctggttctttgagcgcaaatttacgaacgagcatcattggaaccaatcagttatgcttcacgccccttcagggtttgacccggaagcggcaggcaaggctttaaccaagatgatcgaacaccatgatgcacttcgcatggtttatcagcgaaatggaaacgggattgttcagtacaacagagggctggaagaaacagcggttcgtcctgaagtcatccgcttcaatgaatcgggtgctgaacttgaagctgccgtgttaaaggaatcaaaccggattcaaagcagtatcaatttaaccgaaggcccgcttttgaaagcggcgatctttgagacggatcaaggcgatcatcttctcatcgtcattcatcatctcgttgtggacggaatttcatggagaatcctccttgaggatttcgccgccgggtacgcccaagctgaaaaaggggagccgatcattcttcaagaaaagacgcactcttttgctgaatatgcggctcgcctgaaagaatacgcaaggtcaaaagctttcgcgaaagaaatcggctattggcaggaagtcgagaaggcggagacggcatcgctccctaaagatgatgaagcagaggacaaacggatgcaccatacgaaaacggctgagttttctctctcgaaagaagaaacagaacagttgatgacaaaagttcatgaagcatataacacggaaatgaacgacattttgcttacggcgttgggcttggcgctgaaagagtggaccgggcaggaagactttatcatctgcttggagggacacggccgggaggacatcatggaaggcttgaatatttcccggacggtcggctggtttacaagccagttcccggcgctgattcaactgcgccattccgaagatatcggctatcaaatcaaacagatcaaagaagagttgcgccacattccgaataaaggaatcggctatggcatttatcgctatttgaccgaagaaggcaaaaaggcgcagccgatcaagcatgatatcagctttaactatttgggccagtttgcagagatggcggattcgggtctgttcacgagatcagctttgccgtccggcgatccgctcagcccggaaacggaaaaaccgaatgcgctagacatcgtcggctatatcgaaaacggcattttgacaatgtcaattgcctatcattcactcgaatacaaagaaagcaccgtcgccgctgtcgccgcaagctttaaaacttatttgctgcaattgatcgatcattgcttagagctggatggaggcgaactgaccccgagcgatcttggagatgacgaactaacgcttgaagaattagataaactgatggaaattttctaacaaaaaaacgaggtgccttatggggaaacaaaagattcaaaaggtgtatcctttgacaccgatgcaggaaggaatgctgtaccacgcaatgcttgatccggaatcttcctcttacttcacacagctggagcttgtcatagacggggaatttgatttggggatctttgaaaaaagcgtgaatcagctcgtgcgttcatacgatattctcagaacggtttttgttcatcagcaattgcaaaaaccgcgccaggttgtcctggctgaacggcaggcaatagtggaatttgaggatcttgcggacttggatgaggaaaggcaaaaaacccgcattgaccggtataaacaagaggtacaggcggccgggtttaatttggcgaaagacatgctgtttaaaacggcggtctttcggcttgaccggaaaaaataccatctcgtctggagcaaccatcatatcgtgatggacggctggagcatggggatattgatgaaacgcctttttcaaaactatgaagcgtttcgagcaaaccggacggttccgcttgatcagggaaaaccgtatgcggactatattaaatggctcggccggcaggataaggatgaagcggcatcctactgggaacaccgcctttcgggtttagaaagcccgagcgtcattcccggcggaaaaacgcggccggattcaggatcgtaccggaacgaggagttcacgtttgtttgggacaaagacatggtggatgctcttcaaaaggcggcaaaccgctatcatgtcacagctcccaatctttttcaggcgatttggggaacagtgcttgctaaatataacagatccgaagatgtggtgttcggcacggttgtgtccgggcgcccgtcggaaattgacggaatcgaacatatggcagggctgttcatcaacacgatccccgtccgtttaagggtcgatcaaaacgcatcgtttgccgagttgttcaaacaagcacagcagcatgcaattgacgcggagcggtacgactatctcccgctctatgagattcaaaagcaatcggcattggacggccgcttgatcagccaccttgtcgcgtttgagaactatccgcttgataaagagctggaaagcggaacgatccatgagcggctcggcttttccatcaaggctgccggagcttttgaacaaacgaattacgactttaatttgatcgtttatccgggagcggagtggacgatcaaattgaaatacaacggcgaagcttttgacgcggctttcattgagcaggccgcagggcatttaacgagacttgcagaagaggcgattgcaaatcccgaatcaaaagcaggcagcgccgacatgttatcaaaacaggagcaacaaacgctgctcgcttttaatcaaacgaaaaccggttatccaagagaaaagacgattccggagctgtttgaagaacaggttgaagcgtctcctgacaaaacggctgttgccgctgacggaagaagcctgacttaccgcaggctgaatgagaaagccaatcagctcgcgagaaggctgaaagcaagaggcttgatgcacggaaatgccgccgccattatgatggagcggtcgcttgaagcagccgtcagcatgctggcggtactgaaagcaggaggcgtgtacgtaccgatcgatcccggatatcctgaagagcggattcgcttcttgctcgaagacagcggagcaaagatcgtccttacaaaagacagcccgcagatttcgctggaagggtatgaggtactcgccgcaaatgcggtggatgcagaaaaagaagatgccgccaaccttgtacatgccaacaaacccggagatcttgcctattacatttatacatccggatcgacgggcaagccgaagggcgtgatggtcgaacaccgcaatatcgtccgccttgtcaaaaatgcgggctacatcccgctgaagagcgacgtgaagatggcgcagacgggggctgtcagctttgacgccagtacatttgaagtgttcggcgcactgctaaacgggggaaccctttatcccgtcccgaaagagacgctccttgatggaaagcggttcagagtgttcctggaagagaccggaatcacaacaatgtggctgacttcgcctctttttaatcagctcgcccagcaggatccgggaatgtttgcaaccctaagtgatctgattatcggcggagatgcccttgttcctggaatcgtcaacagagttaaacgcgaatcgccggaactctcgctttggaatggatacggacctactgaaaatacaacattttcgacgtgttttttcatcgatcaagcatatgagagaacgatcccgattggaaagccgatcggaaattcaaccgcctatatcgttgatgaacacggcgcgcttcagccgatcggcgtgcccggcgagctgtgtgtcggcggagacggggtggcccgcggctacttgaaccagcctgagctgacagatgaaaagtttgtcggcgatccttttgccgaagggaagcggatgtaccgcacgggcgacttggcaaaatggcttcccgacgggaatatcgaatttctcgggcggatcgatcatcaagtgaaggttcgcggcttccggatcgaattaggcgaggttgaagcggctttggcccgccttgagggaatttcagaagcggctgctgtcattcgggaaaacaataccggagaaaccgagatttgcgcctactacactgcagttggcgcgaggccggccgcacagctgcggacagagctgtcccggtcgcttccggagtatatgattccggctcatttgatcgaactcgacagcatgccgctgacagccaacggaaaggttgacaaacggcagctgccggctcctatcgctgaagagactgacagattcgaagcgccgaaaaatgaaacggagaaaattctggcggcaatctgggaagagattctcggcatcaagcagccgggaatcgatgacaacttcttttccatcggcggacactcgctgaaggcgatgatgctgacagccaaaatacaagagcagctccaaaaagaagtgccgatcaaagtattgtttgaaaaaccgacgatcagagagctggccgaatttcttcaaggggaaacgaaagagaaaaccgctccgattgcgccggcgccgtcccgtgcgaattatccggtgtcatccgcccaacggcgtatgtacatcctcaatcagctcgaagaagcaagcacgagctacaatgtgccggcggttctgcttctggaaggcgaattggataaggagcgtctggaagacgcgtttcgggccttgatcagccgccatgaaacattgcggacatcgttcgaattaatcgatggagaaatcgttcaaaccatccatcaagacgcagtttttcatctgacggaatcagtggcggaggaagcggaagccgaagcggcgatcagagaatttattcggccgtttcagctgaataaggcgccgctcgtccgggcggagcttgtaaagcttgaagaaaagcgccatctgctgatgatcgatatgcaccacattattacggacggaagctccaccggcatattgattcgcgacctggccagcttctaccacggtgaagaggcgcctgctcctaagctccactataaggatttcgctgtgtggcaaaacgggccggagcatcaggagaaattgaaagaacaggaacagtattggctcgatattttcaaaggcgagctgcctgttctcgatctgccgtacgattttccgcggccttcaaaacgcagctttgaaggcgaccgtgtcgtctttggaatcaatcgaaaactgacggcagacgttcaaaagctgctttctgaagccgatgcgacactttatatgttcctgttggccgcgtttaatattttgctgtccaagtatgcgtctcaggaagatttaatcgtcggatcgcctgtggccggcagaacccatccggatctgcacaacattccgggcatgtttgtcaatacgctggcgctccggaatcgtcccgaaggggaaaaaacgtttaaggaatttttgcaggaagtcaaagagacaagtcttcagggctttgccaagcaggactatccgcttgaagaactgattgaaaaactgccattgccgcgggatacaagccggaatccgctgttcagcgtctttttcaacatgcagaacatggaaatcccgacgctgaaactcggagatttgcagatttcgtcttactcggtgcgccatcgcacagcgaagtttgatctgtcgcttgaggccgtggagcatgatggggaaatcggtttgagctttgactatgccgtatccttatttaaagaagaaacgatcaggcgctggagcggccacttcttaaatgtgattaaaacaatctgcgaaaatcccggcattaagctccgggacatcgaactgctttcagacaaagagcgcggacttctcctggaagaagtgaggcgcagccgggcagaacgcctagaggagcggccgtttcatgtacggtttgaagaaaaggcggccgaaatgcctgatcagccggctgttgtctgcggggaaacaatcctcacataccgcgggctagatgaaagagcaaatcaaattgcaaatgtgctgcgaagtgaaggcatcggaaaagacgacgttgtcggcattatgctggatcgttctgcagaggtcgccgcggcaattctcggcgtaatgaaatcagggggcgcttttttgccgattgatccggaaatgccgacgagcaggattcaatatatgctggaagacagcaaagcccgctggctcttaacagaacattcccatcaagctgctctcgcagattggtataacgggagattgatagatgtgagaaacgacacgctgatggcaagcaaaaaacgaccgcatctaatccatgacggggcgagtctggcgtacatcatctatacatccggaacgacgggtcagccgaaaggcgttcagctggaacaccgcaatctggcaaactatgtttcctggtttatcagtgaggcgcgcctgtcagcttcggataaaacgatgcttttgtcttcctatgcgttcgatctcggctacacgagccttttcccggtgctgctcgccggaggagagctccatatcgtccggaaagaaacgtatacagaaccggatacatttattcattatatcggtgaacaagggatcacatatatcaagctgacgccgtcgctgttccatacggtcgttcagccgcaaagcttcgctttggcaaaggggcttcagtcattgagactgattgtactagggggagaaaaaatcaatccgaaagatgtcgaacggttccattcccgctatccggacacccggttcatcaatcattacgggccgacggaaacgacgatcggtgccatcgctaaaccggtcgaaccgggcatgatccggcaattcgccgagcgcccgacgattggacggccgatttcgggcgccggagcactggtattggacgcttcccgccggcttgttcccgcgggagcggcaggcgagctgtatattacgggaagcgggcttgcaagaggatatgtgaacaaccgggaacttacggctgcgaagtttatcgaaaatccttacacaccgggcacattcatgtaccggacgggggatctcgtccgccgtcttccgaatggggagattgaatttttagggcggacggatgatcaggtgaaaatccgcggctacagaatcgaattgaaagaaattgaagaggccttcattggacttgaacatatagagagagcggtcgttctttcatttacggctgactcagggctagacgaactgtgcgcttatattcaagcgaaacgacagctgccggtttccgaactgagagagcgtctttctgagcggcttccgtcgtacatgatcccgtcatatttcgtaacggtggataaaatgccgcttgcggcgaacggaaaagtggaccgcagcgcgctgccggagccgcaaggtctaagtggtcaaagcgattcatatagagcgccgtcaaccgaatttgaaaaagccctctgcggcatttgggaggaggtgcttggcgttcggccggtcggacttgacgacaatttcttcgatcttggcggacattcattaaaaggaatgatgctgacatcggaaatccaatccaagctcggaaaaaaagtaccgttaaaaacgttgttcgattgtccgacagccggcttgctcgcccgcagtatcgaagccgatggacaggcagaacaaagcgggattcagcctgccgaaaaacgcgactggtatcccgtttcatccgctcagcaacggatgtatgccctccatcatattgaaaagaacggaacgggctacaacatgccgtctgttctcatgctggaaggcgtacttgatacggatcgcttaagacgggcattcgcagacttggtgaaccgccatgaaacattgcggaccgcattcgttgaaatcgatggccgcaccgttcaaattgtgcatgaaaaagcggacattgacttaaaggttattcatattcatgaagaggacgcagaagcacagatcaaccgctttatcagaccatttgatctcagcaccgctccgctgatcagagccgagctgctctccatcagctctgcgcgccatctgcttttgattgatacgcatcatattattgcggacggcgtttccagaagccttttcgtcaaagaaattgcacagctttataaaggcgcttcgctccctgaaccgaagctgcattataaagattatgcggtatggcagcaacaacctgaccagcaagaaaacattcggaaacaggaagacttctggctccggcagtttaaggaaaccgttccggaactcagccttccgctcgactttccgcgtcctcctgtccaaagctttgccggggaccgggttcactttaaagtatcaaaaggcaccgcccttaaaatccgccgtttgatggcgaaaacgaacacgacgctgaatattgtaatgctcgccgtttttaatctgtttttaagccgtcttgccggccaaaaggatattgtcgtcggctcagcggcagcgggcagaacgaatgctgatttgaaagacgtgccgggcatgttcgtcaactcgttggcgctgaaaaaccatgtacctgatcaagcatcattcagcgggtttttggaagaggtgaaaaacaacagcctcgcagccctcgaccatcaggactatccgtttgaagagctgattgccaagcttgatttgccgcgcgatatgagccggaatccgctgttcaatgtcatgctgacaacggaagatcctgataaagaaacgctcgatttagacggtctgataatcaagccgtatgagacttcacatgccgctgccaagttcgacctgacactgggggcttttgaaaaagatgatgaaatcggtcttcagttcgaatatgcaacagatttatttaaaaaacaaacgattgaacgctggagcggatatttgcttaacctgctcgaagcgattgccgaaaacccggatgcaagcctttcagacctttcgcttctggatgaagccgataaacggcggatcttgtacgaatggaacgaaacagttctcgacgtgccgcagaacaaaacagtccatgagctgttcgaagcgcaagtcctccgcacgcctgaccgcggggcagcggtgtacaacggcgtgcagtggacgtacaaagagctgaatgcgcgcgccaaccgtctggcccggctgctgatcgaaaaaggggccggccctgaacagcgggttgggatcatggtgaagccttcgctggaaatggcggccggcgtgctcgcgattttgaaagcgggagcggcctatgtaccgatcgaccccggctatccggccgagcggatcggatacgtactgaaagacagcggtgcagaactgcttctgacgcaaagcggattaacgatgccggacgcatttaccggagaagtgatcgatttgaatagagaagcctccattctggccggcgagctttatcccgaggatgacatcaatccaagcgcagaggctcagtctgacaacctggcatacttgatttacacatcgggcacgacaggccagccgaaaggcgtcatggtcgaacatcaatcgctcgtgaacttgtgctattggcataacgatgcattcgcggtcaccgaacaggacaaaagcgcgaaatatgccggcttcggctttgacgcttccgtctgggagatgttcccgtactggatcgccggagcggagcttcatatcattgatgaagcgatccggatggacattacgcgtttgaatgaatatttcgaagagaacggaataacgatcacgttcctgccgacacagctgtgcgaacagttcatggagctcgacaaccagtcgctgcgcgtgctgcttacgggcggagacaagctgaagcggatcgaaaaacggaactacacgctcgtcaacaactatgggccgacggaaaacacagtcgttgcgacgagcacggcaatcgatcctgatgaaggcatgctttcgatcggaaagccgattgccaatacgcgggcgtatgtgcttggacaaaacaacgaagttcagcctgtcggcgtcgctggcgagctgtgcatcgccggccgcgggcttgcgcgcggctatctgaacaagccggaggaaacggcgaagcgttttacggaagacccgtttgtgccgggcgagcgcatgtaccggacaggggatgcggtcaaatggctggaagacgggcggcttgagtacatcggccggatcgaccagcaggtgaaaatccgcggcttccggatcgagctttctgaaattgaagtccagctcgcgcggctctctgaagttcaggaagcagtcgtcaccgacatcgaagacgcctacggcaacaaagcgctgtgcggctatgtcgttgcggacgaacagcttgatacagaaagcctcgcccgtaagctggggcagacgcttccggactacatggtaccggcgtattgggtgcagcttgatgagcttccggttacggcgaacggaaaagtcgaccgaagggcgctgcctcagcctgacgtcgaagcgcagacagccgaatacaaagcgccgcgcacagaaacggaacagctgttggcagacatttggcaggatgttctcggcatagaccgaatcggagtcacggacaatttcttcgcgctcggcggggactcgatcaaaggaattcaaatggcaagccggcttcagcagcacgggtggaagctggagatgaaggacttgtttcagcacccgacgatcggggagctcagttcttatgttcaagccgctgacgctaaaccgatcgatcaaggccctgtcgaaggcgaagtcacactgacgccgatccagcgctggttcttcgaacggaaatttacgaacgagcatcactggaatcagtcggtcatgcttcacgccccttcagggtttgacccggagctcgtcgaacagacattggcggcattgacagagcatcatgatgcacttcgcatggtttatcaaaagaataacggccgcctcattcaatataaccgcgggccggatgaccgttcgttcgcctttcgagtggttgacctgcgatatgtcaccgacattgaaacggaaatagccgctcaagcaaaccgccttcaggcaagccttgatcttgaaaacgggccgcttgtaaaggctgaacagtatcagactgcggaaggcgaccatttgctgatcgtcattcaccatttggtgatcgacggcgtgtcatggcggattctgctggaagactttgcatcaggctattcgcaggccgcacagcagcatgatgttgttttccctgataaaaccaattcgtttaaagactgggccgaagcgcttgaggcttatgcgcaaaccgaacgcttccttaaaacggccgattattggcgcagacttgaacaagagcgtatttgtgagctgccgaaagatcgtgctgccgcagaaagaaaagcggaaaacacctctgctgttaagtttgaattaagcgaagcggagactcgtctgctgctgacgaaagtgcatgagccgtatggaacggatatcaacgatatcctgctttccgctctcagcctgacgatcagggaatggacgaacggctccaatatttgcatcaatatggaaggccacggcagggaggaaatcattccagggatgaacatttcgagaacgacggggtggtttaccgcacaatatccagttgttttaaaaagccaagcagcggcagggttgcctgagaccattaaaaacgtcaaagaaaccctccggcgcattcctgacaaaggaatcggctacggcatccttcgctacttaacagaccggaaaaaagccggtgcaattttctcgatcaagcctgacatcagctttaactacctgggacagatcgacagggaggtgcagaccggcttctttgggccttctccttatgatatgggaagacaggtctctgaaaggtctgaagcactctatgcactgagcttcagcggcatcatcagcaaggaaaaattcatcttgtcatgttcattcaatacagaggaatatgacaggcagaccatacaggagctcatggacagattcaaagctttcctgacagcattgatcgaccattgtacagctaaagaagaacgcgaatttacaccgagtgatttttctgccggcgatcttgagatggaagaaatgggcgacctgtttgacgttcttgaagaaaacttgaaataaccaccgaggacttgcccgcttgtcaagcgggcgagcctatgaaagggggatacgatcttgagccagtttaaaaaagaacatgtccaagacatatactatttgtcaccgatgcaggaagggatgctgtttcatacgctgctgcatccggggcaaggcttttatattgaacaaatcagcatgcaggtgaaaggctcttttcaaaaggatgtattggaaaaaagcatgaatgtcatcatcggcaggtatgatatattccgaaccgttttcgttcatgaaaaaatgaaacgtccggttcaagtcgttttaaaggaaaggtcatttcaggcagaagaaattgatctatcaggactttctgaagcagaacaaaatgagagaattgaagattataaacgaaaagataaagaaaaaggatttaacctctcaaaagacattccgatgagaacggcggtttttaagaaggggcaggatcgttacgaatgggtgtggagctatcatcatattctgcttgacggatggtgcttcggcattgtcgtacaggagctgttcgaagtatacaacgcgctccgtgaaaacaggccatacagcctcgggcctgtcagaccttacaaagaatatattaaatggctcgaaagccaggacaaacaaaaatcgctggtctactgggaacatcatttagccggattcgaagggcagacgacattcagcgaacagcggaaaaacccggagcaagccggcaatcagccggaagaactgctgtttacacttccaaaagaagatacagaagcgttcacacagctagcaaaagcgcatcataccacgttgagcacggcgcttcaggcggtgtggtcggtgctgctcagccgctatcagcgatcccgcgatctgatcttcggtacagttgtttcaggccgccccgctgacattcaaggtgtcgagcacatggtcggtttgtttatcaatgtcgtcccgaaacgggcgacctttggcccgcaaacgacctttacggagctggtcgctgatttgcagaagcaggcgctcgaagctgaaccgcatcaatatgtgccgctctatgaaattcaaagtcatatagcagcgccgaacttaatcgaccatattatcgtttttgaaaattacccgctgcaagaagccaataaacagcagaaagaaaaaaatctcggcttcacaatggacgagatcagcgtttttgaaaaatcgaattatgatctgaatttgcttgcttcaccgggtgaagaaatgatgctgaaacttgcatacaaccggaatatattcgaaccatctttcatcttgcggttaaaagaacagcttttgacagccattcgcgaggtcatcagagatccggagcagccgcttgacgacatttgtgtcgtttccaaaaaggaaaaagagcgacttctccatgaatttaacggtcaagtccaacggaagcaaatcggcctgacgattccccaatggtttgagcaatacgctgaagcgctcccggaaaagcccgcggtatcagcggccgggcggacgctgacatatcgggaattgaacgaaaaggcgaacaaggtcgcgcaccttttgcgcaaaaagaacgtcggccgcggcgagcccgtcgcccttttgttccgccgttcgccggaaatggtcatcgcgatactcgccgtcttaaaagcagggggcgcctatctgccgattgacccggaatatcctgaagcacggattcagtatatgctgaaagacagcggggctgtttgcatgctgacacaggaagagcttgccggccgggcggcgtcgctttcttttcataagcatacgatcctgatcgacgatcctgctgtgtctgcagaaagcgggagaaacctcgaaatcgccgccgagccggacgaccttgcttatatcatgtatacgtctggcacaacgggaaaaccgaaaggcaatctgacgacacatgccaatattacaagggttgtaaaagagacaaactacatcagcctttccgagaaagacaccttgctgtccctttcaaactatgcgtttgacggcttcacatttgatctgtacggcgcgctgttaaacggagcaaagctggtggtggccgatcaggcgacgattctccatatcggcaagctgacagaagcgattcagaaggaaaacatcacagtcatgtttgtgacaacggcgctgttcaacttgctggttgatgcgggaacagggtggatgaaagggattcgcaaagtcctgttcggcggagagcgctcatctgtcagccatgtcaagaaagcatttgctgccatgggaccggacaggatcatccatgtatacgggccgacggaaacgaccgtcttcgcgacgttctatccggtcaaccgtatggaagacagcgcggtttccattccgatcggcaagccgataaacgaaacgaatgcatacatcctgacggaaaataaccggcttcagccgattggagcggtgggtgaattgtgtctgagcggtacaggagtatcgcgcggctatttgaacaggccggaactgactgcggaaaaattcgcgccgcatccgtttaacagcggtgaaacgatgtacaggacgggagatctggcccgctggctgccggacggcaatatcgacttcatcgggcggatcgatgatcaagtgaaaatccgcggacaccggattgagctcggtgaaatcgaagagcagctgatgcgctgccaaggcgtaaaggaagccgttgtaaccgccaggaaaagcgggaacggggatgcggcgctcaccgcttatgtcgtcccggtgcagggaactgaggttgcaaacgaggaggttcgccgccaattggcgcggaggctaccggcttacatggtgccggctgcgtatatcatgcttgaagagctgccgcttaccgctaacggaaaagtcaaccgacgccttctccctgaagccgatggccggccgaattcaacagagcgccgtgcaccccgcaatgctacggaagaaaagcttgcagtgatttggtctgaggttctcggcagacagcagatcggaatagacgagaacttttttgaaatcgggggacattcattgaaagccatggccgtcgcctcccggatgctgaaagatctcgcaatcgatgttccggtgaatgtgttgtttgaaatgcccacaatcgagggcctcgcggcttatatcgaccaaggcggccatgtggatgaagtgaaaaaaaccgtcttcaatcaggcaagcacccgccatttgttcgctttcccgcctgtcctcggatacggcatcatgtacggcaagctggccgaacaaatgccggaatacaggattcacgcgttcgactttatagaaagcgatgaccgcgctgtgcgctatgcagaagccatctccgaccttcagcctgaagggccgctgacattgatcggctattcagccggctgcggacttgcctttgaagtggcgcaagcgctcgaaaagaacggacggaaggtcgaaaagctgctgatgatcgactcatatatgaagaacgatgtcagcgatttagaagggcggtcaattgaagccgatacggccgccttgatggaagccaacaaggacaatgaatatatgaaaatcaagacggttgccgatggcatcgccaaaaagatgacagcctattattcttactttgtcaatcttgtccatcaaggaacggtcagctcggagattcatttgatcaaatcagagcacgcaaaaccgctcccggcatggctttcgttgtggaaagaaggaacggagtcttcatatgatgaatatcaaggcgctggaagacatgatgaaatgcttgcggacggctttgttaaaagcaacgcagatctcatcagacagattttgggcgaacgtgccgctgtaatcggaggtgcatgatgcatgaacgagatcattaagcagtttggagcgccggcaagcggtatgcagttgatctgtttcccgtttgccgggggatattcggcatcattcagaccgcttcacgaacatttaaaaacagattttgatatgctggcgatcgaaccgcctggacacggcacaaatcgaatggcgcttgtcgacaatttggaaaagctcgccgatttgtatatagcggcgcttaagccgcggctttcctctcaattcgtgctgttcggccacagtatgggcggcatggttgtttacaggctggcgcaaaagcttgaacaagaagggatctttccggcagccgctgtgatatcagcgatacagccgccccatattcagcggcaaaaggtgtctcaccaaaaggatgacgcatttctcgaccatctcattcagcttggcggaatacccaaagaactggcagagcacagggaaatgatgaactttttcctgccttcgttcagagcggactacagagcgcttgagacgttctgccataccgatcatacgccgcttagatcgcctgtgcatattctgaacggagaccgcgatgagaaatgcatgagggatgcgcttggctggaaaaagtgggcgaatacgatcgatttccactatttcaaaggcggacatatgtatcttttatcagaaacggaacaagtagccgccaagttgaaaacgattgccgcggccagccgcagtacggctgttccgacaatgtaaagaaagcggaaaatcggtgtgctgcagctgccgattttccgttttttcagctttttttcagccgattttcccgccgaaccatcgtcgccccaataattccggcaatgatcatccccgttccggcgaagtgaaaccattcgagtgattctcccagccatataatccccgccaaaatcgtcaccagtgtcgccaagtgattaaacatgctgattttcgcagcttctatttttgacagtgcataatttgataaaaatgatgtcgcaaacgatgacaacacgcctaaatacaataccgaaagaacaaacaccggatcagtgaagggggcaaaaaatccgctcagcgtgccgtctgacatatggctgattccggcgatgccgttgaaaaaaagaaatcccgctcccgttgtgacatatgttaattcaagcgagctgaaggttcgcgtcatctttctggcgagcacgctgtagcccgccgatgaaagcgccgaaagcaaaatcagcgccgcccctcttaaatcggaacttccggtgcctgcacttttcatcataaagatgcaggccacccccgccgctgacaagacggtaaaaaagaattgccgtttcgtaaaccgctcatttaaaaaataagcggcgaatatcatggtgaaaatcgggatcgccgcttgaatgattccggcttcagacgaagacgtgtagacgagcccgaaaacttgaaaagcaaaaaacatgacagggtaaaataatgctaaaggcagcactttcagtgcgtcttttatgctgatggcgatcttcacccatccgagcagaaggggaataagcgcagccaaaaaagcgaccgtaaagcgatgggccagaatgtcgaccggactcgctgcagtgagagccaatttgacaaagaaaaaggaaaatccaatgataaaagcatagagcaaagctgccgcataagcagatttgttcaaagtcgatcatctccgttaaagtatgcatgcaatacagatattttaccggcttctgtcatcttatacggaagcgaaatctgatacaatacaaaaaaacggaatctgtaccgttacagattggcgaaggagacgaacatgcacaaatatgtcgcactgatgaacgaattggaggatatgatcgaagacaaatcctttcaggaaggggacaggctgccttccatccgcgcgctggccatacgtttcaaggtaagcaaaagcacggtcatcagggcgttgaacgagctggaaagacggcacctcatctattcagtgccgaaaagcggctattacgtcgtgaaaaaaacgaatcagcggcccaactccggaaaggctgtaatcgatttcgcagcatccgctcctgatccggatgtttttccatacatcgattttcagcattgcatcaataaagccatcgatacatacaaaaacgatctgtttatttatgggacgccgaaaggtctcccgtcgttaatccaagccgttcagaaagagctcgcaaacagccaggtgtttgcaaaagaggaacacatatttattacatcaggcgtccagcaggccctcgccttgctcgcttcaatgccttttccaaaccggaagcggaaagttctgatcgaacagccgagctatcatttattgattaaataccttgaagttcacggcatccccgcggtcggcatcgagagaaccgccgaaggcatcgatatggacgagctggagcgcatctttcaaaccgaagatatcaaatttttttatacgatgccgagattccacaatccgctcgggacatcctacacggaacgggaaaaaacggccatcgtcaagctggcggagaaatatgacgtctatattgccgaggatgattttttaggagatttggagaatgataaaaaggcggatccgttacattactatgacgtttcttcccacgttatttatttgaaaagtttctcaaagattatttttccgggtctgcgggtcggagccgccgtgctgcccgattctctgacaattgtgttcaaccggtacaaacagctgctcgacattgacagttccatgctgtctcaggccgctttggagatctatttgaagagcgggatgtttgaaaagcataagcaaaagatccgttcttcctatcaaaaaagatcatgccttctgcatgatctgctaaaagaatgttccgcgtctctaggggatgtgtttgaatttcatcctcccgcacagccggctatccacacccatattgaattggaccggacgatcccggcatcccgtctgattaaaagcctacaaaaacgggacgtcctgctcgaaccggtcaacgctcattatatgccggcttttccaaaaagaaatctattgaaaatcaatacgtccaatgtgaaggaagaggacatccgcagcggcatcgagcggttgcggcaagcggtggaaaccgcttatttttagggcgggactttttaaagcattgacagttcagcgcagcttttcatcacaatccggccgggaaattcaggtgcggcggaacacaccgccattttatagccggggtcaatttcataggcttgtatatagcaaggcggatagccggggggagtttccaccgaagctcgcccctgttcgttcagtttgacggagaaggaatcaagcggcagagacaggccttttcccgcctgtttaataaagctttctttcatcgtccacaaatgatagaaatacgacaggcgttctgattcgtccttttccatgagatcatcgtgctcggaaggtgaaaaaaaccgtttggcaatgtcgaaattgatcggcttgatcttttcgacatccactccgatcggctgcgcgccggctccgcacacgatccattttccggagtgggaaatgttgaaatgaaagtcgttcagaccttcagcagccggtttgccgtaccttccttctgtaaaacggatctgctcattcggcaaatgaaacgtttcgctgatgatgtgcctcgccagcacttctccgatcagcgtccggctggcatcttcgggatatctgtatctgcccactttttttcgcttttcttcagacaccatggccatcattcggttaaattgaccggcttccggcagctgatccatataaacggcgtaaatcttcatcaaacgcaacctcttcacatgatatttttctgctttcattttagcaaacagacagcaggaaagataggcatgatacttgtgcagaatggagtaatgaacatgatagacggaacattgataaaagatacatgcttcgggagggagcttttgatctatcttcctccttcatacgggagcggtgaaaaccgctatcccgttctatacgtccatgacctgggagatttattcgatccggcatacagcaacagtctgcgctcaatcgaaaagctgttttcgagtcaggaagtgccggaattgctgctggtcggagtggctccaaaagacagggaaagcgaatacacgccttttcccaagcggcatttgctgccgaataaacgggagtacggcgggaagggcaacgaatatgccgcttttttggccaatcggctcaagcctcatatcgaccggcactaccgaacaaatccgagccgtgaacaaacaggaatcatcggaaagtcgttcggagggttgatctcggtttacacagcttttctagcatcggagacctttggaaaaatcggatctttgtcaggttctttctggtttgaaggaataaccgagtttatgaagaataaccgctttgagaataagcatctgcgcatttatatggatgtcggaagcacggaagggacagacagggataatctgcagaaagagatgataccgaggacaaaggaagccttcagcctgttaacagaaagcgccgcctccgaaaaagaactgaaatttgtcattgatgaaggtggctcacatcggcttgagcggtttgcgaagcgttttccggaagccgttaaatggctgtttggctcctgtcacaacagcgcacggaatggcaggagtttctgattggcatgaagtatcgttgtaaacgagaggcgcggaagcaatggacattctgaatcgtttggctgaaaaacatcgattatattgaaaagcactggatcagccgctgaaacacgaagacatcgccaaaatcgcatattgttcgaaatttcattatcagcggatgatctacatgctgacgggtgtcacctttgccgattacattcggaaaagaaggctgacagccgccgcgcaggagctgactgcaagtggttgatgctgcttttaaatacggctacagcacaccggaatcattatcgggaggccttcagccgccttcacggcatcagcccttcacaggcccgagaaaaaggcggacgctcagggcatttccacgtctatcctttcatattcaaataaagggagtggaggatatggattacaagattgttgaaaaagaaccgtttcaggtgatcggcaaagcgttggaggttacggtcaaggatggtcaaaacaaaaaggatattccggctttttggaacgaattaaatcacaacggctttaccgattctttaaaaccgcacatcggcccgcttggcttccttggcgtctgcatggattttaacgatcaacccgatacgttcaatttttgaaaaaaataccgcttacacgcctgccggctgtgtcgaaaaaacgattcccgccgcaacttgggccgtctttgaggccatcggccccgtcaatccggctggtcaagccacatgggaaaggatcttctcagaatgttttccggcgactggctatgaactggcgaacgagccgcaatttgaagcctatcctgaggacggggatattatggcgcaagatcatatcaccgaaatttggataccggtggtaagcagaaataatcctgaactagaaaaacggatgaaacgctcatccgttttttttcagcgacatatgtacaggcttggcagctctgatgcgccttcctgccattgctgcttttaaaagctgtttggactgcggcaaagaaaaccgcaaaatcaggccggttaaaatggcggttaaaacagtaccgatgccgatcggcccgccgagcagccagccgatcaataaaatcgtcagctccattccgtttcggacccactgaacgttccagcccgttttctcggaaatcaaaagcatcagggagtcacgcggacccgcaccgagatcggccgatacataaatgccgactccgtaaccgataaaaataacgccgatcacgaatacgacagtgcttgaaatatacgtttccgggtctggaagaatataagtaaagaaatctataaaaataccgattaacagcatattgagcacggcgccgattttcggccatgcttttgtaaataaggacgttaaacctacgatgaccgccccgacaataatcgcccattggccgaccgtaaggcccaaaagcatatacagcccgtagtgaaacgcatcccaaggaccgatgccgagcactttcccttcaatcgtaagagaaaccccgaaagacaaaacaatcaatccgacaaaataaaaaagccagcgcaaaacaagttcccgcttcaatggattcccctcttttcaaaaaaacaatcaattgtcattgtatcatattcttcagtggggtgatatccaaaaaatgttttattttgtgtaatacttgtaccaaactttattaaaataacaattgactaaaagatatttccattttataaaattaatgtataatatttactagtaggtgatctttatagggatagttgcttaaaaggtatatagactttaatggatttgggatcattctaaaaaaggagagtaaacatgaagaaactttatattagtgctgtcctgggtttattgtttgtttttgttggtggaacaaaaatacatgctcaagaaccacagaacaataacggggttttggatgagaataaattcattgatgaaacagtgtattcatatacgcagccaattagcatacaggatggtgaagtaacaacacaagcgaaaaaatatatcaaaaccgtgtcagttaataggagctataaaagtcttttaaacattgtagttgccagacattactctgatactactttcacttacggaagcggtaagttatataagagtcccagagctttaagtaatgattggtggacacttcctccgaattttaaatcaggaagctctaaaagctgggactggtacaatacagggaaaggtgcaacaggacgttctaatttacaagtaagatacacttggggagttccaacaccatgggggccagttggatctaattatagctcaagaataaaggtttcatttaaatcaaatggcagttggtatacaaattaaagctatatatgaaaggtgacataccgatgggtacaatagggataaactttaaaaacattcaacatcaatatcgtaccaaggatgtgctaaggggggtgagtttccatgccgatccctcctccatcacgttcttggcaggcgagaatggagccggaaagacaactttgataaaggttgctctcggcttaatcagtccgaaggcaggaaatgcgctgttcgacgggcaaagcgtcggggaaatccgggagaagatcagctgcgtgtttgatgagcctcctgtttatcctaatgaaagtggtcttgacaatctaaagtttttatcaggtatacacagccttgatcgaaagtggagtcaggaggtttgtgccatgctcaaattggatgagggacttttaaaacaaaaagcaaaagcgctatcactgggtcaaagacaccgtttagctgtagcggccgcgttattgcgcaaacctaaatatttgtttcttgatgagccgtcaatcggcctcgacccaccgtcatggcagctggtccaaatcgctttaaaacagatgactgccaggggatgtgcaattttgattacggggcaaaattatgacgcgattgaaaatctcgctgacaatatagcgattttgcaaagtggaaaaattatcttctccggtcctattgtaaaacttgttcaagcatttcccgtatatgttcgaattgtaactgatgaccatcgggaaatagctgtgcagtttccagaagctgaacctgattcttccggaatataccgcatcgtttgcgaatcaggtgaacaggcccgcgccgtgattgatcaggtgaggagaagcaccctgaattttcaagagctatcgactgaaaaagcgtcaatggggaaaatggtgacagatatttacaaggatggatttcagtcggaaaagagagggttaacgtatgaatccgttcaaaattgaaacgaatcaattgaagaatagcatgcttgtgagggtttgtatcgcgttattattttgttgctttatctgggggcttctcactttatatcaaagcgctgaaggcgaggaacgcagacaggaaaagattcaccaatccgtcattgatgaagtgaaaaagaatggggcggaggaagagcttgaaaacggcggattggagattgaaaaaaatgatgatatagcgcgtagtatgtacataggacttcatccaagtgttactcctaatctgtttttattaatcctcgcgaacattgggccaattgtttttattataatcggatctcaccttgtcggaagcgaataccatcaggggactgtgaaaatgaaagccgctcacatcggatggagaaaagcggtttctggaaaactatgcgcactgttaagtctggttattgttatggttattgcagctttattgcttggactggcaggcggttggctggcttggacgttcgccacggcacattcagacttagccgcttctcttgaagtgaatgcagctgtctcctatccgatattaattttgtttttaatgatcggattgacattttacagtgttctaggaatgactgtcacgctgttgacgaaaagccggctggcgggtgtgctgatcagcttggcgatcccgtatgctgagcaaatgatgagtctgccttttttgccattgactgcttatcaatccctcatggttcaccattttatttatgtcgacggaagcatcatcggccagccctatttgacagagccgatgggcgaaccgggcgcttgggctgttcttgtatgctggctctttgttgtcattgcggttcagcagtttgcagcgaaaaaacagcagattttatgaaaaaaggggggaatggcgttgatttttttagttaggctgatctgtcttgcctttttagcctgtctggcgctgttgttttatgcaccttttctggcgatgcccgtttggatcgctttgatcattgccttaatcgtctgtctgtatcttgcctttatagaggaaatgaaggaatggagaagacgaaagcactaatcctttcttcagcgttttttcttgtataaaagaacgtttgctaaaacgaaatagatgacggccgtcccggacacaaacaaaaaaattctttccactctaatgccgtcatgtatgcgaagcggaggagttcgagatgttcatccaagtaataagcctgggtatatgcgccgactgtcatgccgataaaggcgaatagaccgaccacattgagcaccattctcatactgaatgtctttttctctttttctctttttcgtggttcattttaaagaaatcctttccaatatgaatttatcattctattgtacgaatacaacgcttggatgattcaaaaacttcttaatctattgttaagaagtttttttattttggagaaaatgtaaaagataaaacaatttcatgaactttttgagcgaaggcctaaaaatataggaatattataccgatatggcaagtgaaatctttttctgaaatataaaagacaaggcaggagagaaaatcatgcagcaacgcaatacaccggatgtacagagatggtttccgagcgaggacggaaatgaagcaaaacgaaacgagttcctatcattgatcgagcagctgatcgagggagtggacaacctgaaaaatccggatcaggtcaaccttggcggcgagaagaaccgagagggcttcttttatgaaaagctggttgcagagagtcggattccgcatgaaggtgcgccgatgaaagaggttaacgaagagctgttgaagctgttgcacggccatccgtatcacaccaaatactttttcacgaacattctgccgatggccagcatcccggggatattaggcatgcttacggcgtttatggtcaatggcaacaacctgtgggatgtgtacggtccagccggagcggaggcggaagtgaaggttacagcgatgatgtcaaagcttgctgggtatgatgccgaaacaagcggaggatatacaacgtggggaggacaaggggcggtatacagcggcctcagaatcgcgattgccaaaatggctccgtcatccctaaaagaaggggttcccggcaatttctatgcgttttgttctgaagcggctcattacagcttgtataagtcgatggaagccgcaggactcggcagcgatcatttaattaaagtcaaaacaaatctcgaccattccatggatacggaagatttgcgagagaagcttagacaagtatgcgaagccgggggcattcccgtctatatcgtagccacgacgggaacgacagatgcgatcggcatcgatgatgtgagcgctgtccgccgtgcggctgaagaaaccgcgaagagcttcgggctgccggttccgcatatccacgccgattccgccctgggaggattttttgccttttttaatgagtacgatctgaatgagaacgctttatccttcagtcccggtgtcctcagcatgatcaaaccgattcaggaaaaaatgaggcatctgcatgctgccgattcgctttgctttgattttcagaagctcgggcagacgccttatgtgacgagcctgtttcttgtgaaggatcgcaatgacttaaaacggatcgatctggatcccgatgagacgccgtatgtcggccaccgcggctatggggactaccatacgggctacacgctggaatgttcgcgcatggccagttcgatcagtatgtacagcgcattgatggcatttggctatgaaggctatcaaaagctgcttgcccagttccttgaagtcaacctgcattttagggaacagctgtctcggcagattccggaggccgatattgtgaacccggacaactgcggcatgtctacgctgtttcgcatttatcctgaaggggcgcctagatttgaagacgaaatttcgggagcatgcaccattgaagagctggaaagaaacaatgcgcttactgaaaaattatttgaaaagctcggaacaaaaagggacaagatgttttttggcgatacgaaaaaacacttgcttgtgaagtcctgtgaaggggttgaattaccgctttgcgtcagcaaatttttcgtcatttctccgtataccatgcctgaacatgtcccgggaattatcgattatttaaaagaaactattgaggaagtcttccgggagcatgggtctctcatgacaaattaaaggggatatagacgatgaaaacgttgaagaaaaagctaacagaacacatttcagtcaaaattatgattggcgtcgccttagtgcttttaatcacgatcgcatcattttcagccgtgtttacttttatcagcaaagacttgtcagagcagctgaaacagcagttccaaaaccgcctttataccgatattcatcttgctgaaaatcaaatcaaacgtctggacgggaatccgcttgagatcgattccgcagacggtccgctttacaagcagacaaaaatggctgtggacagcctgaaaaagaaaaacaaacttgagaatatttatatcctttccaatgaaggcgggaaggagcggattctcgtgctgtcggatacgcccgatgatttcggcacggattacagcttttctcctgaaatgaaagaagccttgacgacaaacaaagagacggtaagcgacgtgtatgaggacgaatacggcatccaccagtcgatttttctgccgcttgagaacggctcaggagaaaaggtgggaattttggggatcgaccttgatgcttccgtgattccggagacagcggcaaaagcgaaatggtatacaattgcgatctcagcatttgtcttgctgctcggaatggtcatggcctattttctcggttcttacatcgcgaagccgatcaggcagctgatgaaggcttcagaaaaaattgccgacggcgatctatcggccgacatttctgtcaagagccgggacgaagcaggaaagcttgccgaatcgttcaagcggatgagcgaaaatttacaacaattgattggacatatttcagcttcctctgaagaggtatccaagacgagcctgcagctgaaaaatgtatcggctgaatcgagcgaaagcgcagctcaagtggctgaatcgatgaacagcatgagcgagggaatcaacgaggttgtctcttcagtttcggattgtcatacatcggctgccgaaatcgatcagcagcttacacatgtcacagaaaaagtgaacgagatgaagaacgttgccgagggcgtcagcaaggattccaagacggggcaggagcttgtcgaagaaacattgcggcagacccagacgattaaaaacgtgatggaagagtccaaacaagcggcatcagagatgcaaaaccatacagaagaaattgaaaaagtcatcggaatgatttcctctattgctgaacagacgaatttgctggcgctcaatgcttccattgaagccgcccgggtcggtgaggaaggccagggctttgcggttgttgccggagaagtcagaaagctttctgaacgttcggcagatgccgctttatccgtttcccagcttgtggcgggcacgcaggagagcagccggcttgtcatggaacgcattcaggaaggaaacgaagcggttgacaaagggcagattttaatcaatggcacatacgagaatttttcaggaatttttaaaggaatttctcaattcgccgaacgcacagatcaattgcttcagtccttgttaaaagtcgaaaaatcgtatcaaaccatttcgtctgcgatggagcagatttccgccgttaccgaagagcaggcggcaggctctgaagaagtcgctgcggcagcggagcagcaaagcgccggcatgcaggaaatcgcatcggccattcagcagctctccgctttgtcggaagaattgaatcaggcggcatccaagtttaaactggccgctgaataaaaagaacagcctgatctctcttgatcaggctgttttgtttatacaggattcaaaatccggtttaaaaactgttttgttcgttcttccttaggggctgagaaaatttgttcaggcgggccctgttcgacgatgacgccgccgtcgataaagacgacttcgtctgcgacatcctgcgcgaatttgatttcgtgggtgacgacaaccatcgtccagccctcatttgcaaggtctttcatgactttcagcacttcgccgaccagctcggggtccagagccgatgtgggctcgtcaaaaagcatcagctcaggcttgatggccagggcgcgggcgatcccgacgcgctgctgctgtcccccggaaagctggaatggatagagatccattttgtcttcaaggccgaccttttgcagaagctgaacggcttcctttttgacctcttctttattgcgcttttgcacttttacaggcccttccatcacattttcgagcacggtgcggtgcgggaacaggtgataggcctggaataccattcccgactttctccgcaggcggaggaggtcagcaggtttatttttcttggaaaaatcgatggtgaaatcgtcaaaagaaagaatgccgcggtttggaatttccaaagcgttcaggcagcgaagcagcgtcgttttgccggaaccggaaggccctaaaatggcgatcacttttcctttttcgatgttcagatcgattttttttaagatttcattttcgccgaaggatttattcagccctttgatcgcaagcatggtctatttccctccttacttggccacataccggtccaaacgccgttcaatctgctgctgaacaagcgcgagaacaaagcagatgatccaatagatgaatgcggcttccatataaatgattaaaatttggtcaagattgccggccccgatttcctgggccttccggaataattcagcaacaagaatctgtgacgcaagcgatgtatctttaaccaagctgatgaatgtattggataatggcggaattgacacgcgcacagcctgcggcaggatgaccctggtaagcgccgttttttgagtcattccaatcgaataagccgcctcccactgtcctttcggaacggaaaggatggaagccctgatgatttccgacgcataagcgccgacatttaatgaaaaggcaatgattgcgctcggaaacgggtcgatcgtgacttgaaacgctggaaacaagtaaaaaataatgaacagctgaacgagcagcggcgttccgcggatcgctgagacataaatgccgaaaaccgctcttaaaatgcgggatttggacattctcgccagcgccgtgatcaatgcgatgatcataccgaatataaaagagagaatggcaaggggaatcgagtaatagattccccttaaaaagatcggccaaaatgactcacgcacaagatcccacgggatcgcctggccgatggccgccgcttgtatattacttagaaacatcttcgccaaaccatttcttcgctattttcgcgagtgtgccatcctctttcatgtccttcagcgcggagttgaccttgtcaaccagttcgccgcttcctttgcggaaagcaaaatgcgtagtttgcggctcgcctgtttcaaaagcgattttcaggtttttgtttcctgacgtcttcaaatagttcagcaccgccagtttatcgttataggtgaggtcgacacggccctgctgaatcagctgaaacgcttgagccattccttctacgccttcgatttcagcgccggcgtttttcgcaaggtcattatagttgcttgtcaaagactgcgcggcttttttccctttgacatctccttcagactttacatcgttgttgtccgcttttgtgacaacgacggcttgggaagttgtatatgaatcagaaaaatcgtactgatcttcacggtcttttttcccgacttggttggcaacgacgtcaaaacgctttgagttgagtccggcaaacatgctgtcccactgcgtttctttaaattcagctttcaggttgaggcgcttggcgacttcctgcatcacttcgacatcataacctgttaatttatctgtttttttatcgtggaatgtaaaaggttcgtacgttccttcagtaccgactgtcaatacgcctttatctttaattgaagaccagaggctgtcgccggctgcgtttttatccttggaattgtcccctgacgcgccgcatgcggccatcacggtgatcaacagcgtcaataatacagcgaatattgctttcttcattttattccccactttactgattggatttagttgatatgattttacttaaggctcttacaaaagtaaagcataaaccttttttagtatgagtcaagaaatacgtttttagtgatgaaagggagagaagatcattctgattcctgatcgaagcggatcttccattttttaagcctgtattgcaggctttgcctgctgatccccagcacccgagccgcttgtgacacattgtaattgcattttttaacggttttttgaatataatacttttcggcattctcgatttgttcctttaaaggagcggccgaggcggaaggaagcggggcgaacagatcatagccctgctgcggcagctgctcttttgccgctggtttcgtcctgtattgcaatggaaggtgcgtcagctcgattttgtcttcgtaggacatcaaattcatggcgccttcaattaaatgttcaagctccctgacgtttcccggccaatcgtatgaaagcaggaaccgccgcacctcttcttcaaaacccttgacctccatttggaacaatgcgttgtatttgtcgataaaatgctgcgtgagcggcataatatcttccttccggtcttttaatggaggaataaacaaggtgacgacgctcagcctgtaatacaaatcttttcgcagcctctggccgctgacagcgtcgactggatcttcgttcatcgtcgcgatgatcctgacgtcgatcggagtatcctttgaagcgccgatccgcctgatcgttttttcttgaatcgcgcgcaaaagctttgcctgcaatctgaagtccaaagaattgatttcgtcaaggagcagtgttccgccgtcagcttgttcgaaaagacccggacgatccacggctcccgtgaatgcgcctttgaccgtgccgaataataggccttcgacaaggctttccgggagggctgcacagttttgcgagatgaatgggcccgttgagcgctggcttccgttatgtatactttgggcgaacagttcttttccggttccggtgtcgccaacgatcagaatggaggaagaggtccgggtcgcccgctttgcatgttcaatgacttccttgaacgccggactgacgccgttcaggctgtcaaacgtatactttgtgctttctgttttgttcatattttctctgatcaggcgttcaagctttgtgacatctttggcaatctcgaccgctcctttcgtattcccgttttccataatggggaatgtatgattgacggtcgtaatttcctgtcctttgttattgaagtaagtctgtttgacgtttttgttcgttttcccgtgatgcagcgcctgcaggagggtgctgtcatgctggctggcaaacgtaaacacgtccagcacgtttttgccgagcacatcgccgacatccatcccttcaatctggctcatctttttgttatagacaacagatgtgccgttttcatcgacgacatgcaagccgatatcgatttcatctataattccttgaaaaataagtttcagaaaatcataatccttcagcaattgatatccccctttgttcgtatctgtctccattttaagtgaagacttgataagggtgcaaaaaaatatgcatttatttttgcacctttgcataaaaaccgcaaaattttttgcgagttacacatgcaatgttctgaaaatttgcggtattaagagttggcacgatacttgcatataagatagtgtgaaacaaaatacgacatctggcatgtatgtccaaaaataagaaggaggaatcagaatgacggttctatcaaagtccgagaaaattatgaagcaaaccgcacattttggcgcgaataactatcatcctctgccgatcgtgatttctgaagcggaaggcgcgtgggtgaaagatccggaaggcaaccgatacatggatatgctgagcgcttattccgcagtgaatcaagggcacaggcacccgaaaatcatccaggcgttaaaagatcaggcagacaaaatcaccctgacttcgagagcttttcacaatgaccagcttggtcctttttatgaaaaggtcgcttcattaacggggaaggacatggttctgccgatgaacaccggcgcggaagcggttgagtccgcggttaaagcagcgcggcgctgggcttatgatgtaaaaggcgttccggacaatcaggcggaaattatcgcatgtgaaggcaattttcacggccggacgatgctggctgtgtcgctatcttcagaagaagagtataaacgcggtttcggaccgatgcttcccggcatcaagctgattccatacggggatctggaagcgctgaaacaggcgatcacaccgaatacagccgctttcttaattgagccgattcaaggtgaagcgggaattgtcattccgccggaaggctttttgaagcaggctgctgaagtctgcaaagagcgcaatgtcttgtttatcgccgatgaaatacagtcagggcttgcacgtacagggaaaatgttcgcctctgattgggaggacgtcacaccggatatgtacattttaggtaaagcgctcggaggcggcgtgttcccgatatcgtgcattgcagcaaaccgggatgtgcttggcgtgtttaatccgggctcacacggatcgacctttggagggaacccgcttgcatgcgccgtatcgatcgcagctcttgaagtgctggaagacgagcggctcgctgaacggtcgctggagcttggggaatactttaaagaaaagctctcgcaaattgataatcctaaaatcaaagaagtgcgcggcagggggctgttcatcggggtagagctgaccgaggcggcgcgtccgtattgcgagcgcctgaaagaagaagggctgctctgcaaagaaacgcatgagacggtaattcgctttgcacctcctcttgtcatttctcatgaggatctggattgggcgattgaaaagattacccgtgttttgtcgaagtaaagcgaacggctgaacaataaggggattgttcagcccgttttttcgctgtctgtgcgaagtttgtcaaaaattgaaatatcaggaaaatgttcagaagatttaaaaaatagtctatatgtcatagggggagctgacattagggagaattgaaacggaaggggtgaaggcggtttgaatcatgaaaaccgtgaacaatatacactgaaacgaacgatgaaatcccgccatttgtttatgatctcgcttggcggcgtcatcggaaccggcttttttctcggaacaggttatacgattaatgaagccggaccgatcggcgcgattctttcctatttagcgggcggaatgatcatgtattttacgatgctctgccttggggagctcgctgtggcaatgccggtttcaggctcttttcaggcgtacgcgacaaaatttatcgggcctgctacagggtttgccgtcggctggatctattggctcggctggtcggttactgttgctttggaatttttgtcagcggggcagctgatgaaaagatggtttcccgatgtcggcgtctggatatggtgcttgattttcgggctgctgcttttttcactcaatgctttatcggcaaaggctttcggggaatcggaattttggctgtccggcatcaaaattatcgtcattcttctgtttattattctcggcggaggcgcgatgttcggactcatcgacttgaaagacggacaggctgcaccgttcttttccaatctgattggagacggaatttttccaaacggattcggcgcgatctttatcacgatgatcaccgtcaactttgcctttcaggggacggagctgatcgggatcgcggcgggggaaagcgaaaatccggaaaaaacggtgccccgctccatcaaacagacggtctggcggacactggtgtttttcggcctgtccgtatttgtactggcgggattgattccatgggaaaaagcgggggttgttgaaagtccgttcgttgtggtatttgaacaaatcggcattccgtatgccgccgatctgatgaactttgttattttaattgctttgttatcggtggcgaattcgggcttgtacgcatcgacgaggatgctttattccctggcgaaagagggaatggccgctcaggctttaagccgggtcaataaaagaggtattccaatgaatgcgctttggatcacgctcggttttgcgggtttgtccctcatctcaagcgtagtcgcagcagaaacgctctacatttggcttttgtctctagccggtttaagcgcgcaagtcggctggatcacgattacggtatcacagctgctatttcgcagacgatatgtcaaagaaggcggaaaggttgaagacttaaaatttaaaacgcctctttatccttatttgccgctgacgggatttattttaaacagcgccgtccttgtgagcctcgcttttgattcagagcagaggatggcattgtactgcgggattttattcatgtcggcctgctactttgtttatcacgtgtttgtgaaaaaacgccaggctcttgatcgacaagaagcaatgatctatcaaaacaaaacaaacgatgaggtggttattgatgaataaacaagtttctttgattggaatgccgatggacttggggcaggcgcggcgcggtgtggatatgggaccgagcgcgattcgctacgctcatatcgtggagcgcttaaacgagctgggctatgatatcgatgatctgggcgatgtgccgatcaaccgcgatcagccaaaaggagacgaagggctgaaaaatttagtttccgtactggaaggaaaccgcaagctggccgatatcgtcgacaatgtcgtcgagcagcgccgcttcccgctcgtgctgggcggagaccacagcattgccatcgggacattggcgggtgtagccaagcattatcaacagctcggcgtgatttggtatgacgcacacggagacctaaatacgcttgagacatcgccgtcaggcaacatccacggcatgccgctggcggtaagtctcggtgtcggccacgaaaagctggtcaacctccacggctatgcgccgaaaatcaaaccggagcacgtcgtcatcatcggtgcgcgctcgcttgatgaaggagagcgcaaatatatccgtgaaaccggcatgaaagtctataccatgcatgaaattgacaggctcggcatgacgaaggtaatggaggaaacgatcgagtatttgtcagcaaattgcgacggcatccatctgagccttgatctggacggtcttgatccgagtgacgctccgggagtcggcacccctgtcgtcggaggcatcagctacagggaaagccatttggcgatggaaatgctctatgacgcagatatcattacatccgccgagtttgttgaagtcaacccgatactggatcataaaaataaaaccggtgaggcggccgtcgaactgatcgaatcattgttagggaagaaactgctgtaaccaatgcgaaggagagggcatcggcatgatgccttctctttttttattggcgcattcccgggcgcttatcaaaataaagccaaaaattctctcacaggcttcggcagaaaactgccggccctccaaacgacagacggctgcagaatgaacggattgttttgaatttccaatgtctgaacatgccgtgcaaaatgcgccggcagcatggacagcggcagaatcgtcgctccgaatcccgaagtgacgaggctgagaagcgttgtagaatcatggcactcacaaacgaccctcggttcgaggccagatgattgaaagtgatggacgacctcgtcgtaaatcccttttccgtgcgacggcctgagcagaatcagcggcaggccggcaatttctttcattccggcttctccttttaagccatacgactgattccctggaagaacaagcttgcatggaacctccggcaggctttttgattcggtgtttttgctgtggataggcgttgtcgtgacggctgcatcgatctgccggctttccaggagctcgcttagccgtgaaggctcaccttcccaaatgttaaacattaaattcggatacatatctctgatcttcgagacttttgagagcagcagggccgcgcagtaaatcgtcgagccgacggcaagggttccgttgacttcttcacgcagctcccgcacctccaagatggaatcctcaagcttgtgcaggatttcttttgctcttttcaaaaaaacttctccttcgtaggtcaacgtcaggtttttctttttgttccggtcaaataaaacgactccgagctcctcttccatctgcttcaactgcctggagagcggcggctgtgcaatatggagccgcttcgccgccgttgtaatttttccttcccgggcgattgtaacgaagtattttaactggcgaatatccattttcacggcactcctttttatacctttagagtattatatatagatttaacagatattttcaatatggtaaatagaggcgtatcattttaactgaagcaccaggaaggaaagggggggcgcatatgaacatcatcgtcggaatcacgggcgcgaccggcgcggtatttggcgtgcggatgctggagtggctgaagaaaaccgacgcagagacacaccttgtcatctctccgtgggcagcggcaacgatcctgcacgaaacgggatatacgatgaaagacgtggaaaagctcgcatcttttacgtattcccacaaagaccaggcggcccgcatttcaagcggttcctttcaaacggacggaatgattgtcgcaccgtgcagtatgaagacgttggcgggcatccgcaccggtatggcggataacctcttgacccgttcggcggacgtcatgctgaaggaacggaaaaagctcgttctgttaacaagggagacgccgctgaaccagattcatcttgaaaacatgcttgagctgacaaaaatgggggcggtgatcctgccgccgatgccggctttttataatcatccccaaaatctgaccgaaatggtcgatcatatcgtatttcggacgctggaccaatttggcatccatctgtctgaagcgaagcgctgggaaggtatgaaacaggagaaataaggaggataacagaatggcttatcaagattttagagattttttaaatacgctgaaaaaagaaggacagcttcttgaagtccaggaagaggtgaagccggaacccgatttgggagcagctgcacgcgccgccaacaacctcggagacaaatcacccgctcttttattcaacaacatttacggctataacaatgcccaaatcgcgctgaatgtaatcggctcctggccgaaccacgcattaatgctcgggcttccaaaagacacgccggttaaagaacaattctttgagttcgcgcgccgttataatcagtttccagtaaaagtgcaaagagaggagacagcgccgtttcacgaaaacgaaatcacagaagacatcaacctgtttgacattctgccgctcttccgcatcaatcagggcgacggcggcttttatttagacaaggcatgcgtcatttcgagagatgtcgaggatccggaccacttcggcaagcaaaacgtcggcatgtacagattgcaggtaaaaggcaaagaccgcctcggcattcagcccgtcccgcagcatgacattgcgatccacctgcgtcaggctgaagagcgcggcgaaaacctgcctgtcacgattgcgctcggctgcgaaccggttattgcaacggcggcatccacaccgctcttatacgatcaatcagaatacgagatggcaggggccctgcaaggcgaaccatataaaatcgtcaaatcaaaactgtctaacttagatatcccatggggcgcagaagtggttctcgaaggtgagatccttgcgggcgaacgcgagtatgaaggtccgttcggcgagtttaccggccactattcaggcggacgaagcatgccgatcatcaaaatcaagcgcgtctgccaccgcaacaatccgatttttgaacacctgtatttaggcatgccttggactgaggttgactatatggtcggcattaatacatgtgtgccgctttaccagcagcttaaagaggcgtatccgaatgaaattgtcgcggtaaacgcgatgtatacgcacggcttgatcgccattgtatcaacgaaaagccgctacggcggattcgccaaagccgtcggcatgcgcgcgctgacaactccgcacggcctcggctactgcaaaatggtgatcctcgttgacgaagacgtcgatccgtttaacctcccgcaagtgatgtgggcaatctcaacgaaaatgcatccgaaacacgatgcagtcatcatcccggatttatccgttttggcgctagatccaggttctgaaccggcgggaatcacccacaaaatgatattggacgcgacaacgccggctgcaccggaaacaaggggacactattcacagccgctcgattcccctataggaacgaaagagtgggaagcaaaattaatgaatctgctaaatcaataaaagaggagagtgtttcatcatgcatacatgtccgcgctgcgaattaaaaaaagcggaaaccgtcagcaaatcacccgttgaaggagcctgggaagtctatcaatgccagcactgctttttcacttggaggtcatcagagccggagacgatcacaaatcctgaaaaatacaatccggcctttaaaatcgatcccgctgaagttgaaacagctgtacaagtgccggcgattccagaccggaaaatctaaagggaggcatccggcatggctcagctatcaaacgaactatttcagcttttaaacggagagaagctcgccggtaagcggcacgaagcgatgatgctccagaccgtcacagaagacggctggccgcacacggcgatgatcagcgccggcgaaatccttgccctgaacaaaaccgacatccgcctggctctctggcaaggcacaacgacgaccgcgaatattgcgagaacaggacgggcgctcttcgtcgcttgctggaaaggcaaagcacattatgtgcggctgtctttaaagaaactgcccgaattaagagacgccaaacacccgagagcgcgcttcgccggtacggtcgaagcggcccgggaagatatcgcaaaatacgctgatatcatctccggcgttcagattaagctgaaggatgaagcggcggttttgcggcggtgggaagagacgctgggggagctgaggaaatgaagaaaaggaccatggcgaaccatggtcctttcaattatttctgcagcattttattcgtcactttataagccaggatacagcaaattgtaataaaaataatggcgatcgaaaggatcacgagcttttcagcaacggtatatatcggcatgggaagaatagcagcgcagacggcaaacaggctgccaaaataaacaaacaggatcagaggctttttgtattttttccaaatcacttgattaatcccgtttttttcgggatctgccgggtgtttgcggtcttcatctttcatcaatttatttagcagtagataaatgagaaatgcgaataaagttgccgagaaaatattaaaacagaggataaacagcttttccccgatgctcatcttcggattcagaacggcgcttagaacggagccgcatacgaaaaacaggtagacggataagatggctttgtttcttggtttttgtagaaaattagacattcggatctctccaattgtaaatgatttaaacgctgaaaatgagatggaccagaaaagaaaaaatataaaagatgatgatgcttaagatgcctctgcccacaagataaagggcgaaatacagttttctcaggaaccagttgtatcttaatagccgtttgtaaacaaagtagccggtgccgacaagaagaaaaacgaatgtatttgtgattttatgggaccgtttttcaggttttaaaaagatcattttttcatattcaatgatcatatgactcgcaatgattaaaaaacacaaactgtaagcgaaatgagcggccaacataccggcgattaagtattcggtatattcaacaaaagtttctggtgacatcataactcctttatgaatagcggtctcaagcgttttttaactgacataaaaagcttttcattcttcgtcaggcattctttccaaacaagaccggttcagcatttgattcgccgtttgataaaccgcaaaaaaattgcccgatatcacggcaaacagaatcgcaaacatgccggatttccaagcgtgtgagagttcggacatggaaaacacggatattcccacaatcagtatgccgacgaagtagaaagagagcgtgaacggttttctgtgtttcttccaaaagattttcgcgacgatgttgcatcggggcgcgctttgatctttcttcggcttatttataaacacataaatgatgaatgtgaataaagaaattgaaacgaacataaagccgatgacggcaagcctttccttccagttgattgcaggtttgacaagggcggccaaaatgatgattgttgcatatagggaataaactaagaaaatgattttatttctgcctttcaaacatgacatctccttgtgccttaaatcctatgctgtctgatgatatcttgattcgctttgatgaagaagtatttgtggatgaatttgacccccattatagaaaataaacaagccataagcagatagacgatactcatcaacaaatagacggcagactctgaaactcgcaaaacagcatgacttatcatataaccggccgccggaacagccgccaaaagcatccctgtcggagctgctgtctcccttttgcctcttttaggatcagggaatacagccaagtaataccgaatgacgaggaagatagaggcggcatatatgaatagtgacagactgatcaacggtaaatgaaaaccgatggcagaaaacatcattttttgcgccgtgatcagctggcaatatgacataccgctgaaagatacgcccataaaccgaacatattgaaggtgatgaagatattcggtcatgtttctggtatttatgaggatcatccaaacattgatcagaatagcgacagggaggacggcaaaagtgaaaaattcgactttgctcgccagcacaggtaatatgcagagaatatccagcaccaacacgataaaacaggccattccccatttcgtttcccggctgacgggagccttcaaatgagattgaatattgtaaggtaaatctttgtatacaaccgtttcttttaatctcagcaaaacttatattcctccgcttatccctctgaatttttataattctccatgtgttttttcagccagaccttttttctgaagatatgcaataggagcggaagaacgaaaaagaacaagctgataaccgaaacaaacaagggaatttctgaaggggcttgttccaataaaccccatatcgtcatgatgacaaaaaagataccaaccacagggaataaaatcgtgaagatgatcatagcttcgtttatttttttatagaaaatttttttcgtttttcatattgagccccttttcttgatgggtgttttctgcatcggcaacgtttggctttgtgttttttcatatctcgtctatcttcttgaaacaataattcgggaaactgagataagagaaagcatcccgatgtgagatgctttgaaatgtatttattctcgcattgcggcattatgtattttgaaaagatactgtatactcaagcccttttaataattcgttccattgctcaagtgtccttaatgaaatatgtacaggtttttcattgtgttcatcatactgagcaacccaaacgccacgggcagatggaataaaaaagacgatattttgcaagaaaggtccatcgtttaagctagggatgtaaaaatgtgagatattgtttagcgaccattggtttgcttcaagatcggctatcaattgattaaagctatgttcttcctccggtgaaaaagaacttttcttccgaaccttttctgtcatgtctttattactcagccagtcaaagcatttatctgaaagacgaaattttaaaggaatatgttcctcatcagttgaaaagtggtaatagtctttcatcagctgggcaatttcctgctcgtcgacatacgcaaattcatggatgatatcgcggtcaatcatatggaaaagccatgtttcattttcaaaatggtgaagcattaaagtgtttttattgtcaaggttggaacagcggatcatttgttctgaattcacataggaaacgatgaatttctgcatttcttcgcttaaaggattttcgtcttttgaacttttttcttcgttccagtattgttttaaaatgagctggttgacagttgcctctaagattgcatcccattctttttttgatttttttcctaacgatgattcaagaattccttttgcaacaccaggatagtcacataaccctactaaaagcgctagttcttctgatgtacatgtgatgaggtgtttcattgttttcacatccttgattataaacttaaaccttgaaaatgaagtgaaggataaatgataaaatatagaaaatgatgatacttaaaataccgctccccagaaggtaaagggcataataaaattttcttaggaacaagttatatctatatagtcgtttatatgtaaaataacttgcaccaaaaatcaatgcaaaaccgaaattaacagtttttttaaatatatttgaggggggtctgaaagtcccctgctcataataattcatagttatatacccaagaaataaagtgcaaagtccaaatacaaattgagaacttaaaatagcagcaatcaaatattcagcatattcaacaaatactttcggcgtcataatgcctcctatctatttaaaccaacttttcacagactcaaaactgtttttaattcctttttcaatagaaccagcaactttttcaccagcatccttaattgcatcaccgtatgaagagctagcaattgctccagctactccgcctatcgctccaccaacaatcactcccacaggaccgccgacgcttcctattgttgctccaatttcaacacctgtagaaacagcaaaaatgtctgtaccaacacctgctgcgaaacgtcctgttttttctgcaaaacttttgtccgagttctcgggatcggtatattctgtaaggttagaagcgaaagtaactgcggtaccaacaatagggactcctctttctaatgcagtaaacccttttgccttggctgtggactccattatatcaaccgcacccgcttttgtcctcagggcagctctcttgcgaaattctttcccatctataaaactatgttgatttttagggaaccccacagcatgtttaaacatcatggatggactatcataagaagcgacaaatttttgcgcttttttaagtaatgggttgcttggattcgagtcagagatgtttttaatggttctcgcaactttcgaactgtgatctccttgagaagtccaagaacgatgtgacatgacctgaaatttatattcccctttaaatcgctgccacttcgtcggttttcctccttgataataaatttttaattttcgcgtccacgcgattgatgctgttgcgttggctgcgtgataccctaataaggctttatcaccgacatctaatggttctccgaatgtttcgaagtaactaagaatttcgtgtgctatatttgttttttctttatcctgtgtatcaggattcgttaacgtttctgccgctttttcttctaatcgcccaagcatcttttccatcggtgtttcgccggggttttgcaggtcgttttgcaggccgccgggagcttgactgattgttgagtcattttgcggttttaaaattgaaccgcttttatattccgatatttcaatcttcggccccgtatacattttctccagctgctggatgtattgcttcatcgtatcgaggtcttctctcgccgctttcagcgcatttgtctgttcgcggtcgaaggtgtggagcttttcgagcgtctcgctgatttgtctttgcgctttttttgcgttttcgttgacggctgaatcgtctaggtcgggcaggtcgacgatgtggctgacagtggccatcgtctggttggcttttgacgtcaatctgccagtcagcgattcggcttgactgacgccgtcatggagttcgttctcaagaaagctttgcgagataaagccgttttggttcggttcaagggaatgaagcgcacttttcgtcttttctaaaagtcctttatagtcggaaataaaagattcataaaaaagaagaaaagtggtgtggcattcttcgtagaacgagcggatcgcttcaccgcccgcgccttttaaggcgtcgtcaagggaggtgaggcctttgatgctttgtttgacttttgaaatctcgtcagtctggttttttaattcggtcagcgttttgtctaggccggtttgaaaagcctgaacatctagagttttcaatgcgtagtcccttccttctacttggctttgatcgatgacgacagctttttgtcggcgtcttttatggcgttgacagcctgctcggtttgcgcaatttgtttagcgagagccgatgcgtatgcttttgtcaggcttttcaaatctttgttcatgctttcgatttttttgacgacgtcaaggttgtttttgccgctgatatctgtctgcacgttcggcttcacggcttgggctgaatgcttcagttttgagagcgcctgtttgacttcgcccgttttgactttgatttcttgacccatcgtaatcactcctttagcggcgggcttctctttcttctttttccagtttttcgattttcgtttttaatgagctgatatccttacctagcgaatcaatatcatcatttaaagaagagattttctcctttaattgtttaaacacttcatttagctgctttccgcaaatatcattatatgccgttttcatgtcgcttctgacgtttttaaaagaatcagccaggctgccctgccatgtcgtcggcgacagttcgggctttttgatactgtcttttgaatcgtcaaattcctttttatctgcttctaattcagtttggcaatttttcagttgttcgagctgttgttttttgatgagaagtgtaccttgcagcccgtataaaactgttttttcccagatcatgttactgccacctcccggaaaatttgattcaaatgacctgttgggttccgttcattaaaggaccttattaatgttacaacatggtataaatgagttgaataggaaaaatgtaccgtgaacaaagaatctagttgagcggtggagcaggggattccttattatgactgcgattttgcacatttctccattttcctgcaaggtcaaaagacatagttcttaagttttggatttttggtgtgtttattttttgtttcacaaactttaaggtaattttaagaaagaggcgatcttgccgaaccctaaacagggtttttcgaacagaatgtcaaatagattagatatttcataagaacaagggggaattgtctgtttgtgatgaataaaggaggacgggcggaatttctgtcaggatgctcagctgggttcttagaaaaaaatgcggctaaatatatatttatagattgtaaacgctgtcttgtcctcgaccaacagggggatgaagatgaagaagctgttagttgtttatgccgtgatgctctgtttgttttttctgtatgtctacgactactcccggggcgataaagccggttctgcagaagaaagcaggaggcctgcggccgcaggcagtctgtccgaaaaatacgtgatggtcacgtttcaatcgggaatcgaatattggaagagcggtctgaaaggctttgaggatgccgcgcagcttttcaacgtctctgtcgagtatcggggggcggcccattatgatgtccatgagcaaacgaccgtcctcgagcaggtgattgcaaaaaaaccggcgggaatcgctgtttcggcaataaacccaaaagctttaaaccctgtcatcgacaaggcgcacgagcagggtattccgatcgttttatttgattcagacgccccgctcagcaaagcttctacatatatcggcacaaataatatggaagcgggtgctgtggccgcaaggcgaatggccgaatttttgaatggaaagggagaaaccgcggtcattacccagccgcagcagtacaatcatcaggaaaggacgaagggctttgaacaaacgatcaagcaaaaatacccgaacatgaaggttgccgcggttttggacggaaaaggggatgagctgacgtcgaaaaaagaagcggcgaagattttggaggaaaatccgtccatcaaaggaattttcacgactgaagccaatggagcgagcggcgtggcccgtgctgtgaaggaggcgggacttgaaggggaagtatgtatcatcggctttgataaagacaagaaaacgctggacggcatcaaaaacggatcgatttccgcgacaatgagccaggacacatggcaaatgggctattggtcgctgcacatgctgtttttctcaaatcaccatctgaagcatgaacgcccgcttccggccgcaatcgacacaggcattaccatcataacgaaagaaaatgtggcagcctattatgcgaatgattaaacgtttgatcaataatgcgccgatccgtcataagctgatcagccttctcttgttaatcagcatgctgccgacgatcggcctgggcattttatcgggatgggccgttgaaaatattattgaaaaacaggtgatcgaccaaacactgcagctgatcggcgaagtgaacaagacggctgaagtgtatgtcagccacatgcagaacctgacatatttaatatcaatgaatgaagaaatggaagcgttttttagtcataaaaaggaggatggagaggcggattataagcgaaggacgtttttgcagggcctgacttctttatattccgaagcagcgggtattctcgttgtcaatgataagggtgagatgatcagcaatgagatgtatgaacgcacgccgacagatttgacaaaagaaccatggtatcaggcggctctcgacaatgaagggattttcaagatgatcgggaagcctgtcaaccggaatatcagaagccatgtgcactatagggaagatgaggtcgtttccgccgtcagagctgttatcgatcctgaaacacagcatgtgaaaggcgttgtactcatcgatttgaagctgcgcgtcctcgcagaagcgacaaaaaatatccgcttggggaaaacgggttatttgatgatcatggatgaaaatggcggcaatatttattcgccggagacttcgaatctatttctgccgaaaaagtggttccgtcaagaacgttctggatatttttcgaagcggatcaagggagaggaatatcagttcatttatgagacgtcttcctttacgaactggacgacggtcggcgtttttaaagcgggtgaaccggttttcgaagtgaaggaaatccacttgtatgtgcttttgtttttattgacggcggcgtttctcggaatgtcagcttcctattatttgtcccattccatgtcgcggccgattttgaagctgaatgctgtcatgaaaacggcggaaagcgggaatttttcaacattgtatcaggaggaaagggaagatgaaatcggccttttgggaaaaagcttcaatcgcctgatgttcagaatccgcgagctgatgtccgttacagaaagacaggagcgccaaaaaagagaagccgaattaagagcgctgcaggcgcagatcaaccctcactttctctacaatacgctggatacaatcaattggatggcaaggaaaaaaggagcggaagaggtcagcgatctcgtgcaggctttatccaagctgttccgcatttccttgagcaaagggaaagatatcatcccgctgtctgatgaatttgaacatgttgaaaactatttgaaaatccaaaaagcgagataccgcgataaattaaactactcaatcgaaatgaccgggctttgtgatgaccgcctgattttgaagctcgttcttcagcctatcgtcgaaaatgcgatctatcacggaattaaagaaaaaaaggggccggggcatattgcgatcaaaggcatggaggaggatggctcgctaatcatcaaaatcgaggatgacggagccggaatggatgaagagacgctaaagcaaataacggatcaattcaaacacagggacgatacagcgggctacggcatgatcaacgtccatgaacggatcgctcttacatttggcgagccgtacggtataacggttgaaagtcggaaaggagccggaaccgccgtcacgatacggctaccaattttagcaaaagggggaacaagccttgagtgaatgttggcgcgtactgattgccgatgatgaaccgtggattcgggaaggaatacgggatgccgtctcttgggagcgctatcaaatgtcggtgtcggctgaagcggagaatggcgaggaggcttttgagctcgctctcaaacacggtatcgacttattgattgtcgacttgaatatgccgatcgtaaacggaattgccttgatgaaaaagctccgcggcgccttgccccagtgccgctttgtcatcgtgacgggctacgatcagtttgcatacgcgcaagaagcgatccggctgaatgttgatgattatttgttaaagccggtcgatcccgctcatctggaacaagtgctcaaaaagatcagcgtgtcgcttgcagctgagaaaaagaagctgagcgagcaaaagcttgctgagcagcatattcaacaaaacctcggccttctgaaggagcatgttttcagaagctggatcgaaaaccgggcagacgaagaagacgtttaccggcagctcgaatgcctccgtctgccggcgcgcaatcctgaaacgctcggcgtcatcgcggctggacatgtatggaacaaaccgtctgaagccgacaatctgaaagaaaaagtagaacgtttttttattaacgagcgagataaagccgtatttttcgacggagaccgcctgatcgccgcctgtctgtggcgttctgttacggaagccgaacagcgggcgcttgcagagatgatcaaagccgaattgcaggcaagcgcagccgtctgttttgcgaagcttgctgaaaacggccgctcagccgcgcaatgctatcagcactgcaggcagcaagtgtcgaaagcattcaatatctcgccggttgtcataagggccaaggagtatatgcaaaagcatttcactgaaagggagttttctttaaaacagatggcggatgcgcttcaagtctcgtccgtctatttgagcagaatgatgaagaaggagctcggcgtgacatttgttcagcttttgacggagatgcgcatggatcaagcggttcacctgttagagacaacccctctttcaattcatgacattgccgaacaaacgggctatgatacacagcactatttcagcactgtatttaaaaagacgatgggtgtatcccccaatcagtaccgccgcatgtcgggaattgaaagaacaggaggaaaattgtaatgtaagcgcttcaaaaaagtctgatttttataaaaatagttaattaattcaaaagacggacattcgaaagacatggtacagttggcatgattcatgatgggagaaatcaaaaagggggataccaagcatgaaaaaatgctggctgttgatcactgcaatgcttttctgtctcatcgttaccgcttgttcggggaatcaggcaagcggagggggagacaaaggctacgtcggaatctcaatgccgacaaagtcatcggaacgctgggtgtatgacgggaaatacatggtgaaagagtttgaaaagctcggttataaaacggatctgcagtatgcggaagatgtcgttgaaaaccaagtttcacaaatcgaaaatatgattacaaagggcgtcaatgtgcttgtcattgcttcgattgacggagaagcgctgaccgacgtcctagagaaagcaaacaagcaggatattaaagtcatttcttatgaccggctgctcatgaacagcaaacatgtcgactattatgcgacatttgacaatcataaagtcggggaacttcaagggaaatatattgaagaaaagcttggcttaaaagacaaaaaagggccgttcaacatcgaattgttcgcgggatcgcccgacgacaacaacgcgcatttcttttttgacggcgccatgtctgttttgaagccttatatcgattcgggcaaattaaaggtgttgagcggccagacttcatttgagcaaggggcgacgctcaggtgggacggcgcaaccgcacaatcccggatggacaatttgctgagtgcgcattatacaaaggcgaagcttgatgcggtgctttcaccgtatgacggaatcagcatcggaatcatttcatccttaaaaggtgcgggctacggctcggacaagaagccgctgccggttattacgggacaggatgcagagcttgcttccgtgaattcgatcattaaaggggagcagacctcaaccattttcaaagatacgagagagctggcgaaaaaagccgttgagatggcgtcatccgtcttaaaaggcgaaaaagcggaagtcaatgacacaaagacgtatgacaacggagagaaggtcgttccatcatacctgcttgaaccggtcgtcgtcgacaaagagaactacaaaaaagtgctcgttgacggcggttactataaagaatcggaattagggaagtgatccgatgtccgattgcattttagagatgagaggcatcacgaaggagtttcccggcgtcaaagcgctcgacaatgtccaccttcgcgttaaagcgggcgaaatccatgccctctgcggggaaaacggggcgggcaagtcgactttgatgaaggtgctgagcggcgtctatccgtacggtgcgtatacgggcgacattttatataaaggggaagtatgccaattcaaaaatattaagcaaagcgaggaagcggggatcgtcatcatccaccaggagctggcgctcgtcccccagctttccattgcggaaaatctttttttgggcaatgaacaggccagccgcggcgtcatcaattggcgaaagacaaagctggaaacgctcgaattaatgaaaaaagtcgggcttcaagaatctccggatacgcttgtttcccaaatcggcgtcggaaagcagcagcttgttgaaatcgccaaagctttggcaaaaaaagtgcagctcttgattttggatgaaccgacggcggctttaaatgaagctgacagcgagaatctgctgcagctcttgctcgaactgaaaaaacagggaatctcttcgattatgatttcccataaattaaatgaagttacgaaagtcgcagattcgattaccgtgctccgggacggacagacgatcgaaacgcttgatgttcaaagcgggcaattgactgaaaaccggatcatcagaggcatggtcggcagggagctgcaaaaccgctaccctgacagaagcgccgagatcggcgacgtcatctttgaagtgaaggattggacagttcaccatcctcttcaacaggaccgcaaagtggtaaacatggcggcgctttccgtgaaaagaggcgagatcgcaggaattgccggactgatgggctccggaaggacggagctggcgatgagcatttttggaagatcatatgggaaaaacatttccggcacaatcgaaaaagacgggcgggagctttacatcaaccaccctgaagatgccattaaaaacggcatcgtctatgtgacggaggacaggaaaggaaacggtttgattctgaaggacagcattaaagaaaacattacgctgtcgaaactggataaggtgtcgagccgattggtgatggacgagcggcgcgaacaacatgaagcggaggattttcgccggaaattaaacatcaagacgcccgatatcagccagcggaccggaaatttaagcggaggcaaccagcagaaggtcatgctgagcaagtggattttcgcggagcctgacgttttaatcctggatgaaccgacgcgcggcatcgatgtcggcgccaaatacgaaatctacggcgtcatcaatcagcttgccgaagcgggtaaagcggttatcatgatctcttcggagcttcccgagctgctggggatgtgcgacagaatctatacgatgtgtgagggggaaatcaccgccgaattttccaaagaagaagccgatcaggagaagctgatgaaatatatgaccatccgcatgaagagagggggagaagcgtatgcagacaccggtgcaaacggataaagaccgcgctcagcccggctactttcagctgtttcgcgatatgtataagcagaatatccggaaatacagcatggtcattgcgctcgtgtttattatgctgctgtttcaaatattgacagacggaattttgctgagaccgctgaacattacgaacctgattttgcaaaacagctacattctcattttagcgattgggatgatgctcgtcatcatcacgggacacattgatctatcagtcggttcagtcgccgcttttgtcggcgccgtctccgcgatgatgatcattgaaaacgatatgccgctgtttgcggcggtcgtcctgtcgttgcttctgggagcggcaatcggcgcctggcagggtttttggatcgcttatgtcaagattccggccttcatcgtgacgctggcgggaatgcttttgttcagagggctcacgatgatcgtgctggaggggaaatcgatcgctccgtttcctgtgtccttccaaaaaatggcgtccggttttattccggactggctgaacggaggcacgttccatttgacgacgattgtcgccggagcgggtgtgtcgattctttatctcgtatatcagcttcagcagagaaacatgcagaagaaattccaatttgacttgcagggaaaaggtctgtttacagttaaggtgttttttatcatcgccattatcaacctttttacctacattctcgcgacttatgaaggtatacctctcattttgatcacattgttcgtcttaatcgccgggtatacattcgttatgaaaaaaaccgtcatcgggcggagaatctacgcgatcggcggcaatgaaaaagcagccgagctttcaggaatcaaaacaaaacggctcacctttatggtcttcgtcaatatgggcgtcttagcagccctttcaggcttgatttttgccgcccgtctaaacgcggccactccgaaagcaggaaacctgtttgaacttgacgccattgcggcctgcttcatcggcggggcttcggcttacggcggtatcggcacgatcggcggggccatcatcggcggtcttgtcatgggagtcatgaacaacggtatgtcgctgctcggcctgggcatcgactggcagcaggcgataaaaggcctcgtccttctgattgccgttgcatttgatatttacaataagaataaaacttcttaattcataagaaaaacctgtttttgaacttcaaaaacaggttttttcattattgctggacggaacgcccttcctgattcagtgttggatttatttttttaggttccggcagcaggatgttcaaaatgcttgctaccgccaaaataacgattgaaaggtagaaagacaggttatagttgcctgtttggctgtaccagacgcccggcaaataagccccgagcgccgaaccgatctggtggctgaggaatagccagccgagaatgaacccgacggaatactgcctgaaatactgggttgccagcatttgcgtcggggcgacggtcgcaaagtcgaccaaaccgaacaaaaccgcgaagcaaagcaggagcatcgagttgtggctcgacaacagaatgacaagcgacagcgcccttacggcatataaaaagcacaaaattttccggctgctccagcggtcagcgacgacgccggaaatcaaaatgccgatgatgttaaacccggccagcaggctgacagcggcgcttgttacttcggtcgaaaacccgtggtcatgcgaaaaagggataagatgggtatccattaaccccgttgttgtaaatccgcaaatgaaaaacggcaagacgaggaaccaaaacgttcttttgagaaaaacggctttgtatggaatctttttcggctgggcgtccggctcttcttttatctcgccgccctgagcgccgccgatcggctgtacattcttttccgaaggatggttccgcaataacaagatgacgatcggaaatacaataacggctaaaaacaatcccagaacaatgacggtcactttccagttaaaccagtggatcatcatgagcgatccagggacaagcagcatctgtcccgcaccgaatcccgcttccatgatgccgaatgcaagcccgcgcttctcattgaaccaattggtcacgatcacggtcgacgcgacattcgacgcaccgccgacgccgagagaaacgatgatgccatacaaaataaacagctgccacggagaagtcacgagatatgtaaaaaagatgctcaagccgaccagaagcgtgctgagggataaaatgatccgcggtccgaagcggtcgacaagcctgccgatcaccggctgggacacgccatatacaatgaagctcagcatggaaataagcgaaatcgtgcccctgtccattgaaaattcctcttcccaaggctgaataaaggctccgaaagaaaggcgcactccttgaacggccaaaagcgtcaaaaacgtcacaaaaacgataatccaggcgtagtgtattttccgtttcatagatcctccatttcgtcagcctaactcggcatcccagcgttcttcccggagccgctgcccccataataaagtctcgtctttcacttccgtcagtctgaatccgaatttttcatacaaaggccgtgcttcggccatcgtgcttaccgtccataaaaaaatccgctcatactgattttctttgcaataatcgatgagatgctccaagaggcgtgtgccgactccctggtgccgaaaagcggcgtcgaccagaaaccatctgagctgcacggtcctgccggggtgtttgacgagcccgacacatcccgcgaatcttccggcgctctctgcgatccagattttttcgatctcggcgtcgaatgtttcgtgaaggtaatccaaaaatgaatcgtcccagccgtgtgtctccgcgtagaaggcacgctgtttttcgatcatcagtttgatatcgtccgatatatagtaatctcttatagaaacggccgatttttcgggaggcaggtgttccgacaatatgcattcaattgtattcattgcctccgtcagcttttcctgatggcggccgtcgatatgcttcagcatgttttcgatttgttgattggctttggcctccagctttttataaatggattcaccgaagctggttaagtagatatagtggttgcggctgtcctcctcgcttctctttttatagaccatattttctttttcaaaccgcttcaggatccggctgacatagccccggtccaggccgagcgtatcttgaatcagtttggctgtacaatcggccgtattgtgaatttcaaataatatccgggtttccgtcaatgaaaaagggctgtcataaatatgttcattcagaaaaccgagcacatttgtatagaatcgattgaactttctgaattttaatgttgtagaatgattgatttccgccatctcaaaacctctctccctgtaaatcgttgctttaatcaattataataaattagttgatttagtcaagtgtatggaaataaagttaaaaatgttaatgatagaatatattttacaaataaagaaagagaaattcaatcgtacaggaaaattcatccaccttggcaggaaagagggaagaaaacagagtatataatctaacaacctgtttttgaaagcgtttttagtgtcatgtccgtctccgcgtcatatgaaaacgaggaagaaaggatgaaactgtaggatggttaaaccgtatcccccgatcagccggaaagttccccgactattgcatggagccgattacaacccggatcaatggcttaaatatccggacgtattaaaagaagatatccgcctgatgaaactgtcccgctgcaatgtgatgtctgtcggcattttctcctgggtttcgctcgagcctgaagaaggaagatttacatttgactggctcgatcaggttcttgatactttcaaggaaaacggaatttatgcgtttttggctacaccgagcggtgccagaccggcttggatgtccaaaaagtatccagaggtgctgagaacggagcgcaacagggtcagaaaccttcacggaaagcggcacaatcactgctatacgtcgcctgtctaccgccggaaaacggcgatcataaacggaaagctcgcggagcgctatgcgcatcacccggccgtcatcggctggcacatttctaatgaatacggcggagaatgccattgtgaactttgccaagacaagttcagagagtggctgctggcgaaattcaaaacgctggaccgccttaatgatgcatggtggacatcgttttggagccatacctatacagattgggacgagatcgagtcgccggctccgcacggcgaggatgccgttcacggtctgaatttggactggaagcgttttgtcacggatcaaacggttgatttttgccggcatgaaatcgcccacgtccgttcgtttaaccctgatctgcctgtgacgacgaattttatgggaacgtatgccggattgaattattggaagtttgccgatttgcttgatatcatctcgtggatccggcatggcacaacagccggcaggaagacagccggcttggagccgatattgcttttgttcatgacatcaatcgctctcttaaaggcggccggccgttcatgctgatggaaagcacgccgagcatgacgaactggcaggatgtcagcaagctgaagcgccccggtatgcatgaattgtcgtcattacaggcagtcgctcacggatcggacaccgttcagtattttcaatggcggaaaagccgcgggtcaagcgaaaaatttcacggagcagtcgttgatcatgaaggatcagagcatacgcgcgtttttcaggaagtgaaaaagctcggggagaagctcgaaaagctggaagacgtcgcagggacgacagtcgaacccgaggccgcgattatatttgactgggagaatcgctgggctttggaagatgcccaaggtccgcgcaatatcggaatgcattatgaacggaccgccaaatcgttttatgaaccgttttggcgggaaggcgtaccggttgatgtgattcatatggaggccgatttctcccgctataagcttttggtcgccccgatgctctacatgctgcgagaaggcaccgctgaaaggattgaacagtttgttcaaaacggagggacatttgtcgccacttattggtcgggcattgttgatgagaatgaacttacgttcctgggagggtttcctggaggcttaagaaaaacgctcggcatttggtctgaggagatcgatgctcttcatgacggacagaaaaataccattgtgatggatgaagaaaacaggctcggattaagcggaagctatgaagccagcgagctttgcgatctgattcatttagaaggggccgaagcgctcgctgcgtacgaggatgatttttacgcgggccggccggcgctgacggtcaatttgttcggagacgggaaggcctactatatcgcttcaaggaatgaggcggcgttccaagaggcgtttatatccaggctcattgaagagtgcgggattgccaaagtgctcgatacagagctcccgaaaggcgtcaccgcccagctccgcacagacggccgccacgattatattttcgtgatgaattttacagcggaaaacagaagtgtctcgcttccggaggaaacaaatacggacgttttaaagggaacccggaaaaaaggcgcgctcaaactgccgccttacggaacgagcattttacggagaagccataaggcataggaagccttacttttcaggccgacgcttcgtgcaatatgcagcagcaagcaggaagatgacagcagaagtgtacgccaatacaccttgattaaaaacgcagagaaacaccacatttgataaaaccgccaacatgataaacactacggcatagagatttaaacgcaataccatccctccattaatagttatcttaacataaaggaatgtgaaaaatccgcgggcatttcccgcggatccgtcgttatttggctcgttttttcagttttcggggattgacctgatcatcgatatcaggcttgtcgtccagcgcgtcagcaattttttcccaggagacaattttgaagttctgattggctggctgtccattttccgtattttcgccgtcttgggcgacaaagatgccgtatggatattttttgccgaggccgaagccgatgacgtcgattccatcggtatcgcttgtcccgtcgatttctttaccgtcatcaattgaaaaatcggcgacatagtcgtttttcccgcgccggtcatagatggcataacggttatcgccctgactggacgcgatcaaatatccttcgccgtcttctccgtagtaaatcgtcagcccttcaatatcagcggttaaatgcggtccgcctgcgcgatcgacaatttttcctttatctccgccgtttggctcggcgctgaaagaccaaatcgcagcgtcttcttcagcgatgtacattttgccgtattcatcatctgctgcaagcccttctgtttgagagctcattttgaatgagcggacctttttgccttcgacttgtccttttccgttgtcaaacagttcgtattgctcgaattctccgttctttccggtcaccatggcgtagaacttgccggttttctggctgtgatacaggctgaaaccatacacctcctcaatatcggtttgaataggtttttgaggattgacgatgtttttcagcttgtttttttcgccgtcaaaggcgtatatttcaaccgtgtttttgccgtctgaccggtttgaggccccggcaatatcaatttttttgccatcgagcggaaaattgtagcggagatcgacgttgtttaatttgccaaacggataggctgccagctgttttccgtttaaatcgtaaacgatcaagccagattttttatttgttgtgatcagccggcttttttcaggctgcttcggatgaacccaaatcgccgggtcatctgccgcgtcgtcaggggtatccaccggctctgtctctgcatcggcagtcaccgagaagtccttataagctgaagcttcggcacgggggagaatgctccatgagggagacaataaggatgccgcaagagttgataaggcgagcgttttgtaaaagttcatatattaacctccttttgataacacttatactagcaaatcaatgaaaactatcatttgaggaaatgtaaacttttgttaaaaaagcggtggtttaaaggggctgtgagatttagcatacgaagccgcagagaaaacccccggaattctttccgggggttttgctttaacaggtattccctatctctcattaaatcgaaatgtatatatcctgcgaaaaaacagaagaaaaggagtatcagcctattgctttttaattaacacccttcataaatttctgaattttcggtgacagcagcatcaaaatgatcccgagcaggatggatacaccgccgatgatgccgaagtaggcgatctcggtatcaacgctgtaaaatctgacgatctgtgcgttgatggcctgtgcagaagcgtttgacaggaaccatagactcatcgtctgcgctgagaaagcagcaggagccagctttgacgttgcggataacccgactggagacaagcacaattccccgagaacgacgatcaggaagctgagcacaagccacattggattggcaagcgattcagtgccgttgatgtaagcagggaaaatcatgacgacaaatgacagtccggctaaaatcaacccgagtgaaaacttcgtcggcgttgacggctgacggtttccgagcctcatccaaatccatgcgaaaaccggtgcaagcacaacgatgaacaacggattcagcgactggaaccaagaagagtgcaattggacacctaaaaattccaaatgagtgcgtttatctgcataggtggctaaaatattggcgccttgttcctgaatcgcccaaaacatcatcgatgcgacaaacagcggaatgtaagctgtgagacgggaacgttcatcactcgtcgtcttggagcttttaaacatgacgatgaaataaatcagcgggatcaaaataccgagacagctgacgatcatcgtaaacagctcgattgtcatccagcccataaaggcggaatagccaaagatggcagcaatcaccaaaacaccgatcccgatccgtccgaacaccatttttctttcagcgggtgtcagcggattcggcaccgttcttccggcagatccgaggtttttcttccgcgtcgctaaataggtcagcagtccgaacaacatgccgatggcagcaaggctgaagccgagatggtagttgtatgtctgaccgactgtgccgacgataatcggcgcgagaaatccgccaaggttgattcccatatagaagatgctgaaaccagaatcgcggcgggtgtcttcagggctgtacaaatcgccgacaacgcttgatacgttaggttttaaaaggcctgtcccaatgatgatcaagaacatgctgatgaagaaagcggggacgcttcccgggaatgacaaaagaatgtgtccgaacataatgagcacgccgccgtaaaacacggtgtttgcagttccgaggagcctgtccgctatccagcccccgataatgccggacatatagacgagggaaccatatacggccataatcgagttcgctgtcgtttgatcaaacccgaggccgccttttgtcacctctgtatacaaataatagataaggatggctctcatgccgtagtatgaaaagcgctcccaaaattcagtgaagaataaggtgaagagtccgcggggatgtccaaaaaaccccttttgcggaatgttttgaaaagtttctttttgatggtttgacattcgcaatactccttctctttctatgtctattataaaaatcatattcttatataatgttcgtgtcaatacaccttcaatcgatttgaatttttgatcgatgatgccacaagttgtgaagcgctttacaagcggatagaaaaaaattttgggagaaaatttggattgaaagattttttaataaaattttatctatttatgtacaagcggattttactagattggcatatatataaagcaaaccgttttacaaaaggaggctgaaaacagcgtgcagcagcaacctgatgaaatgagaatgacagtggttgacgcgacaaagttcggcgctgtcggcgacggcaaaacagactccacaaatgcgatcaacgaatgtttggcatggacaaagtcgatgggatacaacacggtgtggataccgaacggcacgtacatgattgacgggacgaaaaacggcgacccgcgggctccgtttcgcggcgccggcatcaatgttcccggcaatattgaaattttgatggacgcggaggctgtcatcaaggtaaagccgaacagttcatggggatacgctgctttttatataggcggaacatccgatataaaaatatccggaggcagcatcattggtgaaagagataaacacacatatacaccggccccgaggccgacccatgaatggggattcggaatttgcatcgaaggggcgtcaaatgtcgtcattgaaaacgtgagaatagccgattttacaggagacggaatcattatcagcaacggaggagaagggtatagaccgtcagagcgtattcaggtaaccaattgcgatatcaggcgctccagaagaaataacttgtccatcacagggtgcgacaatgttcttgtagaaggatgcgaaattgcagatgcgggaacaggaaacggaaccgctccttgctttggcattgatatagaaggctatagtgaaggaagcatcgtctatgaagaacccgtcaatgtcatcatcagaaacaacgtgttaaaaggcaatgtcaatcatgccgtttccaacttcaacggtacttctgtcatcatcgaaggcaatgttgcagacggtaccatttcatacggctatggaacggggacgacgattgcaaacaatatcatcaagaaaaatcccgaattcaccgggcagagcactggaattaacggcctcggtgtaggggctttggaagaaagaagcgatgccgtaataaagggaaatttgatttccggttttacgacaggcatagatatccgcggaaaaagcgtttttgctgcggggaataaaatccgtgattttgtaaatgccggaattcttgcttatcaagcgtcgcaagtcttcattgaaggaaattatattgaaaacgacgtacctgaacaaaggtccggcaccgctttcagcatcacgcaatcagacaatgtaacatgttccggcaatcaaattgcaaatgtcgttcttgctgtcaggagcacagggaacgacgtccaaatcaagcataacgtcattaagcaattttccagaggcatatggatatctcaaggaaatgctgtaatagaaggaaactttatttcgccgaacggctttcaaacggtgccggagtcatatgctgtatccgtcacaaacacagcttcggcagttattcaacaaaacaccatcacacgcttcagaaactttccaatatacagctcgacaaatcagcatacaaaaattatcggaaactatattgaagattcaccgctgatcgtcacggtgtttctcacccgcggaacacacgaggttatcggcaatacgataacgctcagcaggccgtccttgccggctgtcctcatttatcttgaccaatcgtcggactcggcgatcctcaacaacacgcttcgaagcaatacggaagcaagagtaacggccattcaaaccaatacgtcaaggcaaacgctcatcatcggcaatacgattgtcaaaggaatgatccattcccaccaaacagatacagtcaatggaaatatcgaagtttaagctccctttggacagggagccttttatgtcctttttctctttttgcgaaagctttccgaggcttcgagaaaaatgataaacaaaaataaaaggatgatgatccactcgcccacttccaggatggcaaacgtcagggagtttacaatggctctttgcaaggtcatgccttgaaatacatccagcatgacggcaaaagcctctaaggaagctaataataaaagcccgattccgattaatttcaactttgcaccactctccgttccccgttattttttctcctttcataaagcactattcacccgggaatagtataaatgtgcttgcgcaaggaaaaatatgaaaaacgaaaaggggattctgacagccatgccattcttttttaaaggtcgtcatcaaaaagataacaaacaagaatctctattgagcggagataagaacccggaaaccgtaaagttgtctgggtttgtgcgtcccttgcttgccgaaaacctgagcctgattaaagaaatgaccggaaacagctccgatattgtcatccgcaagttaaaaacgggcgctggcgaaaaaattgaaatagccgtcgtttatgtcggcggcattacagatgataaagcgattcacgattttttgctggaatcgatcatgaactccgaagaattggcgaaaaaggagtacggcagggaggttcttgagacgattgcaagtgatgccgttgccctgggcggtgtcgaaaaagaaaagcgattggacaaagtgctcgaatctttgatggcaggaaatacgatcattttggccgaggggacggcaaaagcggttattacgaccacgaaaggcggtgaaaaacgctcgatcaaggagcctgagaatcagcaggcattccgcggttcacgtgaaggatttatcgaatcgctcgacacgaatatttctttggtgcgcagaattattaaaaacccgaatctatgggttgaaaaaacgacgatgggaagcgtcacaaaaaccgatgtagcgatcatgtatatcaatggggtatgcgacccgaaaacggtgaaagaagtcaaaaaaaggatggaaagcattgagatcgacagcatccttgaatcgggctacattgaacagtttattgaagacgccgtatttacgacttttccgacggtatatcatactgaaaggccggatatggtcgcaggaaacctgcttgaaggaagaatcgccatttttgttgacggtacaccgtttgttctgcttgtccctgccgtttttattcaattttttcaatctgttgaagattactattcacgctttgacattgcgacgtttatccgctttttacgcgtattgatcttttttatttcgctgattgcgcctgccgtctatgtcggtgcgacgacgtatcaccaggaaatgatcccgacggagcttttgatcgtaattgccgcgcagcgtgaaatcgttccgttcccggctgtggtggaagccctgatcatggaaatttcgtttgaaattttgcgggaggctggaatccgccttccgaaagcgataggttcagccgtttcgattgtgggagcgatcgtcattgggcaggcggccgttcaggccgggattgtgtcgccggcgatggtcatcattgtagcgatcacagcgatttcaagttttgctacaccttctttcgccatggcgatttccgccaggctcgtccggtttttcttcatattagccgcggcgacgacaggtttttacggcattattcttggactgatcatcatgtttgtccatttatgcagcctgcgttccttcggtgttccgtatatgactccttttgcgccgtttattttgaaaaattggggcgacgccatcgttcgcttgcctttgtggacacatgagaagcggcctgaactgatcggcaacgacaataaggtgcgtcaaggagagtaccagaaacccgaaccgccggagtcaggcgatatgaagacaaaacaagaagatggtgatcaaaatgagacgaagcgttaagattgtactcctgcttgccgccactgtccttcttcaagggtgctgggataaaagagaactgacggatctgctgctgatcactgctgttggtattgataaaggaaaagatactgaatacgaattaagctttcaaatcgtcaacccgatcaatgtgacaggaggccttcaaggcggacagggaggagacaggccgccgatttcgagctattctgtgacgggaaacaatctgacggaaatgagcagacatgcgtcagcaaaaatgtcgcgcgagatttattactccagcaccaacttgttggttgttgacgaaaaactcgccaaggaagaaggcttgattaaaattcttgatgttcttgaccgggacaccgattttcgtacaacggcgacgattattatttcccgcggccaaaaagcgaaaacatttatccggacgctgactgcgatcgataagatcccgtcaaataaagtaaacaaaacgctgcaatttactgaaaagcatttaggagaaaatatgaaaacgagcgtccaggatgtcatcaaatgcttgacttcgaaggcaaagcacccgattatttcttcttttaaagtaaccggaaataaggaaaagggtgaaaaaatggaaaacgtgcagtctacatctcctgaggcaatagtcgaagcggacggcttggcggtcattaaagagggaaagctcgtcaattggcttgaaggcaaaacggcgagaggcgttttatggctgcgcaataaaatcagcagaacgtatttgacaattccaatgaatcatgagagagatgccgtcacatttgacgtcatccgccaaaaaacaaaaatcggatctcacctgaaaaacggcaaaccggcgatttcggttgacgtcgacatggaaggggacatcggcgaaacaactgtaccgattcacctggatgatccaaaagtgctgagcgacatcgaaaggaaggtggcaaaggaactgaaaaatgaattgcagaatacgattgacattgttaagcggaacaagacggatgttctgcaattcggtgatgttgtgtatcgcacccaccccgaagcgtggaaaaagatggagggcgagtggagcaatcggtattttcctgacacagatgtcgacattacggttaatgcatatgtacgaagaacaggtttaaggaacaacccgaacattttgaatcatcgtgaagggcgttcttgaatgaaagagagaggagggctttaaatggagaaagcaaaaatcagtgctgcacagctgttcgtgctgattgttctgtttgaactcagcagctctctgctgatttttccagggcaatctgcagaacaggacgcctggatcgcgatcttgttcggaacagtcggagggctggctttgtttatgatgcaccactttttctaccaggtgaatcccgacgcctctccctataaaacgctgatgaatatttttggaaaaccggttggctggagcatgacatttatctacattgtttattattgttacattgcggcaagggttttgcgcgattttggagaaatgctgctgacatctgcttatccgaacacgccgattatcttcgctaatggattgttgattgcagtttgtatttttactgtgaggaagggaatcgaggtccttgcccgttcaggcgagctgttgtttggcatcatgttttggcttgctgtcacaggccttatcctgatagtttcgtcaggcttgatcaaaccgaaagagcttttgcccattcttggaaacggacccggtccgatgtttcatgccgtgttcacgcaaacgctgtattttccgtttggagaaattatcgcctttacattgatcctgccgtatttaaaggaaaagaaactagcgaaaaaagccgggttgttgggaattgccatcagcggcctcatcctggcttttaatgtcgcattgaacatcagcgtgcttggcgtcgatctcaatatgcggtcgcgcttcccattgctgagtacgatccagacgattcaagtcgccgaattcttggtcaggcttgatgtatttttcatgctcgtgctggtgattggcggtttttttaagatgagcattttcatgtatgccgtaaccgaaggcgtgaccgttttattcaagcttaaaaacccctccaaagttgttcatgtcatcggcattattattttgattttgtccgtctccattgccagcaatatttcagagcatgttaaagaaggaatcgagtttgttccattatatgtccatttgccgatgcaggtgatccttcccgcttttatttgcatagtcacttatgtgaaaatgaaaaaaaataaaaaaaaggccatgtaatggattgaccccgcccttagggcaccctttaacatgacagacgaggtgaggtttgatgctctatacggtaaaagaagtggctcgcttggcgaatatcacgatcaaaacgctgtaccactatcataaaatcggccttctatgccccgcagaagtgacggatgccggctatcgcctttacggggtaaaagagctggaacggctgcagcacatcttgttttatcgggagctcgaatttccgctcaaggcaattaagcaaatactggacggcaaagctgatcgactgacgattttgtctgagcagaaacgtcttttcactgcccgtttggacagaattaaacagcttatttctacgatcgatctttcgattcagcaggccgggaaaggagaagcaatggatcaatcaagcatgttcaaagggttttcaagcagcagggaatgggaggatgcgctcgctgaacaaaaccgctatttgaaggaggcgtatgatgtcgatttgctgaaaggagaaccagtcatagcggaagaaatgaatgaaaaagctgaagaggcggcccgttttatgaatggaatggccgaagcgctcagagacggagtcaaacacgaccatgaacaagtgaagactgcaattaaacggcacctcaagtttttgggaattacgcccgacgattttcagtcccagacacgcttctttatcgaagacgattttcatcgcggaatgcttgaaaatcagcaaacaggcctctcgtattatttggctgctgctgcagaagcatttgcttcataataaaagaaggggaacggctcatgccgctccccttatcctgctgatatgcgttttttgacggtaaagccgccccttgaaagcgtgatgttgacatcggatacctttgcgatctgttcatcatgggtgaccatgatgacgcatttgttttcttggtgggcaaggttttgaaagagccggacgatgtcttttgatgtatcttcatccaagttgcctgtcggttcatcggcgacgattaaatccgtgtcacagcagaacgctctgatgatggagacacgctgctgctggccgccgcttaatgtcaatactttctgtctggcctgcttttcgccgatgccgaccttttcgagcatctccaaagcgtattgttccttgtttttgacctgagatccggtgatttccatggccgacgtgatattttggagagccgtcatatacggcagcaggttataggactgaaaaacgatcgatacatattgattgcggaagctggtcagtccgatttttgaaatgttttctcctttgtagaggatgttcccctcttttggcgcgtcaagtccgcccgccaacgataaaaaggtggttttgccggaaccggaagtcccgacaatcgtatataagagtccttggctgaattgaatgctgatatcctcgaatagaggctgatcctgatttttataccaatagccgacattctgaaattctaaaatactgcccataatcttcacttctttctattcttgttttgttaaaatcgttttcggatggagccttaaaacagatatggacggaaggagtgtcgcgaacatcgcaattaaaaggccgattccgccaagtgccattaagttcccgaaggatacttgaatgtcgagctgatcaatggctgagacttgagcagtactttgtccgaagaagcctccgccgcctgggcccatcattccgcctgcagactggctagctgacgtttgttcgatttgctggctcaagagctggttcccgatttgctttgcaatcaggctgccggttaatgctgagatcccgatggcaagcactgcgatcattaagatttcggttaaaaactgtccggtgagtttccggcgtttttcgccgatcgccatcagaacacccatttcgtattttctctccctgattgacatcatgacgatcagtccgagaatcaccgccccggcgaccgtgacaagatagacgacatttttcgagaaggaggcgacattttcaatcgggccgaccatctgctggtacaactggtcattggcgtccaatgtgaatgtatccaaatcaatgcctgttttcttggcagccgcaatgaaagcgtcgatgttggaggcgtcgtccatattgtagaccgcttcatctatcgcgttttgataatcgtcgccttttaaggccgatgccgccgtatatggtgtatagattttgttataagggtttaaaaaggcgaagttttgcgcttgattgtctccggatgaagtcgttttatagattccgacgatttttaaattgatcgttgcatcttcatcgctgctcgctttgactttgatcgtatcgccgaccttcagctcgttttcttcggcaagcgtttcttcaatcacggcgactttttcattcacatcatcctttgttaaagcacggccttccgtgatcttggacgtcccgtcggcaaattcgtcgacgagggctgtgcttgtcacaccttcgattgatacgtcagcctgcatcatttgccggccgccctgttcattgccgcccgatccggccggctgatcgctgtttgagtccgttgaatcctcgtcaccgctttcgatcggatcgaagttgtccgctaaagcagatgttgaggagatgaagttatagcttttgacatggtaaaggctcgcaagtttctcggctgatttgagagaaacgggggtcgattcaaaccttttccggtctcctgagtcctgctgttctttcatcattttttccctgtcaactttgagcgtgacgctgcctccgagctgttccctcgccagttcgctcgatttcacggctgccgactggatcgtaattcctgtcagcacgagcacgcaaatcatcgtgaaaacaaacaattgtaaaagtgtttttccttttttcgctttcatgctccaaaaggctcgtttgaaaaaattcataacgcgtgattcctccgtatctatttcatttattattgctgccaaatctaacggcagcaggacttttgccttatgcttgatttcatcttagccgctacttatgaataaattatgaccaaactgttgccagacctttaaatgttcagaatggaattgagaaatggctgggccctatgtaaaatgaatctaacgtttgtctagcggaggcacttttacgatgaaaatattaatgattgaagataatttaagcgtatgtactatgacagagatgttttttgcaaaagaaggatttgaaacagagttcgtccatgacggactcgaaggatataaccgttttaaatcaggtgattgggatttgctgatcatcgatatcatgctgccgtcgatggatggggtcacgatctgcaaaaaggtcagagaagagagcacggttccgattattatgctgacggcaaaggatacggaatcagaccaggtgctcggttttgagctcggggctgatgattatgtgaccaagccgttcagccctttggcgcttgtggcgagaatcaaagcggtgagccggagatatcaaaacgccggccggcaggattccgctgacagcgacacgcttgaaacggaacattttaaaatcaataaaaaaacgagagaagtgtttttggacggcgttcaaattcaaaatttgacgcctaaggagttcgatttattgtattacttggtgcaaagcccgaaacaggttttttcaagggagcagctgcttgagcaggtttggggataccaattctacggagacgagcggactgtggatgttcatattaaacggctgagaaaaaagcttggcagcgactcgcggccgtttctttacaccgtatggggagtagggtacaagttcgatgaagattaagtatctctatcagctgctggccagtcacatcagtatattagtcttggcttttctcatcacgggggcgctgttttcacactttgccaaagactttgcatacgagagcaaagtcgatgagctgtcttcctacggctaccgcatcatgggcgaaatggagatgcggccgaaaggagcgccggccattatgaagccgtttgaggaaattttgcgaagcaggaagatcagcttttttctgtttaatgaaaagaaagagatcttgatgacgccggccgatttgcggccgcgaaaactgctgctcagtgatgaagaatggaaagagcttaaagatggaaaggccgttgtcgtcaaaaccgactttaaccgttttaatgaggaagtatcggtcgtcgctctgcccaacatcgtcaacaatgaatttcagggaggcattctgctgaccgctccgatcagcgggaccgaagaaatgatcagcgacatgaaccgctttatgctctttacggcggcgggtgtcatcttagtcgctattctcttaagctggctgacgtcgaaattccatgtcgcccgcattcagaagctccgcgacgccacgaaaaaagtcgcggccggggattatgacatccatatcgaaaaccgcaataaggatgaaatcggtgatttgggcgacgactttaacattatggcccgcaagctaaaaagctcaagcgaggaaatcgaccggctcgaaaagcggagaaggcagtttatcactgacgtttcacatgagctgaagacgccgctgacgacgatcagcggtttagtggaagggatgaacagccagacgatacccgaagaccagcaggataaatgtatgaagctgatcacggaggagacaaaaaggctgattcgcctcgtcaacgaaaaccttgattatgaaaaaatccgctccaaccagattacattgcaaaagctgcattatccgctgatcgaagtgtttgaaatcattaaagagcagctggcgcttcaggcggaggagagacagaatcagctgatcctcgatgtggaagatcatgtaatggtcaatgccgattacgaccggctcatccagattctcgtcaatattacgaagaacagcattcaattcacaacgaacggaaccgtttggctgagaggccgggaagactacaaggagacggtgatcgaagtagaggataccggaatcggcattgatgaaaatgatatcgaaaacatttgggatcgtttttataaagcggatttatcacggacaaacacaccttacggagaatacgggctggggctgtcgatcgtcagacagctcgtctcccttcacaacggcacggtagagattgaaagcgagaaaaacaaaggaacaaaatttatcatccgcctgccgctgacggcgagagatgatgatgaatagaaacccgccagacagcgtctggcgggtttttgttaatctttaattttgaatttctgaatcaggtgctgcagctcttcggcgttttgcgcgaggatctgtgatgcggcggcgatttcttccattgaagcaagctgctcctgggttgccgcactaaccgtttgcgtgcttcccgctgcagtctcggctacttctttgacgccggaaatcgcggtttcaatttcgcttgtgccggctgtcaggtttttcaccaagtttgtcacatcattgatctgtgtgacaacctcagttatcgagttttcgattttttggaaagcgcctccggcttcatgaacgacgacaagtccttctttgacttcgccggttgccgaaatgaccgagttcatcgtctgctttgtatcgttttgaatgatcgtaatcaaccttgtaatctgttctgctgactgggccgattgctcggctaattttctgacttcatccgcgacgacggcaaagccttttccttgttctccagccctggccgcttcaatggccgcgtttaaagctagcaggttcgtttgttcagcgatgctcgtaatcacttcggtaatattcccgatctcatttgaacgttctgttaaatgtttaaatgcttctgaaagagaaacgaccgtttcattaatagactgcatttgtgcgctcactttatcaatggctttcgtgccttcaagcgacatcttcgccgtctggtctgcggtggcggctgccttttcggcgctagaagaaattcttccggcaaactcggtcattcccttaataacggttctgctgttttcaacgctttccacctgctgatcagagcctaccgcaagctcctggatcgtcgttgagcctttgtgctttcatcagcgctggcgctcaattcttgtgatgatgaagcaacttggtgggacgtttcgccgaccgtttcaatgatcgaacggacgcctgctaccattttgttaaacgatgcggtcagcaatcccaattcatccttcgattgatatgttcctttgacagtaaaatcgccttgctctgtttctgcgaacagcgcctgaatgtctttgatcggctttgtgatcagccttgtcattaagagtccaatcgagatggataaaacaagcgatgctgcgatcacaatgatgagaagcgtgatgatggaaccggcttctttagaatcccgctgatagatcgttttggcgttgtcagcatttagcgtttgaatgtcttcaatcagctggttgaccgtttctctttgaggatccatctcttttagatagacatcatatgctttgtcattttcgttcttcaccgccaagctgagcatctcgctgctgatatcttgcaatttcttgtattcgcttttgaagctctcgtatttttcagagacgttgtccattaatttcagctgatcgatcttttccattaaggtgttgttttcttcgtttttttccttgatgtttttttgcaaagtatcatttcgatcgctgtctttcgtcaccattaactcgaatttgtacgtatcaagatcgaggttgttcgcttttaatcttgcaaacaactggttgggaatcaattgatcttgatagatcatctcggaacctttggaaagcttgctcagtccgcctaccccctggatgccgacaattgacaaagccagcgccgaaatgataatgatgacaaacagtttgcttctgatttttatatttctcaacagattcatatggtgttctcccatcaatttatttactttacatatcggctttcaaaacggttttgtgaatcaatttatggcaggcaatttaagggaaggggatattttctgacaacaaaaaaaccccataaaaaaggggtttttttaaacgagaacttttgcgaaaaattcctggtataatgcgcggaccgcttgtttttcctgagcttccttaacgccgaacatcatgctgacttccgaggagccctggttgatcatttcgatgttgacgccggcttcagacaatgcttttgacgctcttgccgtcgttccgacgttatggcgcatggcttcgccgacgaccatgatcagggcaatattgtgttcaatcgctacttcatcagcatccaactcttccttgatccgtttgatcatccgtttttctgctgcttgatccatttgattctgccttaaaatgatcgtaatatcgtcaatgccggacggaatgtgttcatatgtcagctcttcatcttcaaggatttgcaggacgcggcggccgaagccgatttctcggttcatcaaatatttgctgatgtaaatgctgcaaaatccgctgtcgccggcgatcccgacgacaggtccgttcgtgttgtcgcgtgtggcgacaactcttgtcccttccgcgtccgggttgtttgtatttttgatctgaaccggtatgcgcgcccggaaagcaggaatcaatgcttcatcatgaaagacggaaaagccggcatacgacagctctctcatttcccggtatgtcagctcgcggatttctttcgggttggatacgatcgccgggttgacagaataaacggcgtcaacgtcagtgaagttttcatacaactcggctttcaatccattcgctaaaatggagcccgtaatgtcagagccgctgcgcgaaaacgtcatcacttctccttcctggctgaatccgaagaagccgggaaagataatgatgcccttttgctgtctcagctgaaacagattgtcgtaggactcgggcagcacttgtgcgttgccgggttcgctcgtcacgaacagcccggcgtcttttggactgacataatgtgcttcaactccccggtgcctgaagtaggccgctaccagtttggcattgttatcttcgccgcttgctttgatcgcatcaataaaccgttccggatttgttttatcaccttcgagcagctgaagcaggtctgcccggatccggttgatcacgtcatcggcaagcccgagctctagcgcgatatcggcataccgtccgacaatcgcctcaaccaggccggttgcttctttcgataataagtactgttgggcgcattcgattaacaggtcagttactttcgtatcctcgggatgccgttttccgggtgccgatacgacgacggccctcctttccggatcggaagtgacgatttgaaatactttctctagctgggctcctgatgcgagcgagctgcctccaaatttaacgactttcatttgttacatctcctaaagtttaaattttcgaaataaatttaattttaattattgcgctttttacaagaagaatcaaggtttttctttcaggaaagaacaaatgtgtttttgagaaggactcatcatagaggaatcgcacttcaacctttgtatctattaatcttattgactatgtcagaaaaaatggtaagatatataaaggcccttattgataatgataatcattaacgtcggcggagggtttgctttgttgtgcaaggaggctactgcagcatgaaattacgatacctattgctaatgctcatcattctttcattcagctcgatattcatcggcgttaaggagctttcgcctcttgaccttttccgctttaatgaggacgaaattcaaacgctttacataagcagaatcccgcgcttgatcagcatcgtgcttgcgggaatgagcttgagcatctgcgggctgatcatgcagcagctgacgcgcaataaatttgtttcaccaaccaccgctggaacgatggattgggctcggctcggcgtgatcattgcgatcgtgcttttttcgtctgcagggatagtagtcaaaatactgtttgcctttgtttttgcactgtttggcagctttttgttcgtcaaaattttggacagaatcaagttcaaagatgcgattttcatccctctcgtcggaatgatgctcgggagcgttgtcagcgccatctatactttcatggcttatcagtacaatattattcaaaacgtcaatgcatggtttgaagggaatttttcgctggtcatgaaggggaggtatgagctcttatttctgagtataccgctcgttatcattgcctacctgttcgccaataaattcacgttggccgggatgggggagtcattttccatcaatcttggtttgaaatacaagcgggtggtcaatatcgggctgatcatcgtatctattatttcgtccgtcgtcatcctgacgatcggcacgcttccctttttgggattgatcatcccgaacatcgtgtccatttacaggggagatcatttgaaaaacagcctgcctcacacggcggttctcggagccgttttcgtcttgttttgcgatatagcgggacgtctcgtcatttacccgtacgaaatttcggttggtttgatggtcggcatcatcgggagcggcgtttttctttacttgcttttaaggagaaaagcctatgcgtcataaacagaaaatgcttgtactcatcgtgatagcagcagtctgcatcgggctgtttctgttctacggtttgccgtctgtatgggaatatgcgcttccgcggaggtttgccaaggtttttgcgatcatcattgtcggtacagcgattgcgtattcgtcgatgattttccaaacgatcacaaacaacagaattttgacgccgagcatcctcggactcgattctctctatgttctgctgcaaaccgggattattttctttttcggtgcagccaaactggctgaccttggcaaaaacggcaattttctattgtctaccggtttgatggtctgcttttcatttgtgctgtttttcctgatgttccgccgcgggggaaggcacatcttcctgctgctgctcgttggaatcgtgttcggcacattgttcagaagcctgtcatcctttatgcagatgctgatcgatccgaacgagttccaagtcgttcaaaacaagatgtttgccagcttcaacaatttgaatacggacattttagtgcttgcttcgctcgtcattctggcgattctcgtttacgcttggcggtttaatccgtactttgacgtgatttcgctcggcagggatcaagccgtcaacctcggaatcgattacgaccggacggtgaagaaaatgctgatcgtcgtcgccgttctcgtttccgtgtctactgccctcgtgggtccgatcacatttttggggcttctcgtcgtcaatgtggcccgggaggtatttaaaacgtataagcacagcgtcctgattcccggagcggttttgttcagcatcattgcgcttgtcggaggccagttcattgttgaaaagctgtttggtttaacggtgacgctcgtggtgatcattgattttatcggcgggatttattttatttacctgttgctgaaggagcgtaaataatgatagaagtacgagatatcatgaaacaattcggagagcagaccgttgttcatcccacgactttaacgatacaaaaaggaatgatcacgtccttcatcggaccgaacggagcgggaaaaagcacgcttttgtccatcatcagcaggctgatcggcatggacgccggaaaagtgctgattgacggcaaagaaatcggcgcttacaaaagcaatgatttagcaaaaaaaatcagcattttaaagcagtccaaccagatcaacatcaggctgactgtcagggagctcgtcagcttcggcaggtttccttattcacagggaaggctctcgaaagaggactgggcatatgtcgatgaagcgattgattacatgaagctgagagacattgagcataaacaccttgatcagttaagcggcggccagtgccagcgcgcttttatcgcgatggtcattgctcaggataccgactatatattgcttgacgaaccattgaataatctcgatatgaaacactcagtagagattatgaagctcttgaaagaccttgtcgaaaatcgcggaaaaacgatcgttattgtcattcatgacattaatttcgcctcggtttattccgacagaatcgcagccctgaaaaacgggcggattgtaaaagaggggccggcggaagacattatccaaacgccggtgctgaaagacatctatgatatggacattccgatccaacaaatcggagatcaaaaaatctgtgtatattttaaatgatgaggtgacctgaattgaaaaaactatctttattgattatggcattgataaccgttcttgtcgtagccgcctgcggaaacaaagctgctgacacagatgcaaaatcttcctctaaaaaagaaaccgtcacaattaaacacaacagcgacacaacagatgtaccgaaaaacccgaaaaaagtcgttgtcttcaactttggaatgcttgacacgcttgatgagcttggcttaagcgaccgcgttgtcggccttccgaaacaaacccttccgtcttacttgaaaaaatataaagacagcaaatttgaaagcgtcggcggactaaaagagccagattttgaaaaaattgctgagcttgagcctgatttgatcatcatcgaaggcagacagtctgaacagtatgacgagtttaaaaagatcgctccgacgatcgacattgagcttgaccagaagaactacatgaacagttttaaagaaaataccgaaaacattggaaaaatcttcggcaaagaagatgctgtcaaagaagcccttgcgaaaatcgatgaaaaagtagagaaagccaacaagctggcgaaagaaaaaggcggcaaaggattggtcgtcttaacgagcgataagcaaatcagcgcgtatggaagcggctcaagattcggcttgatccacgatgtgctcggcgttgaacctgtcgataaaaacatcgaggtttcccttcacggccaaagcgtctcttcagaatatatctctgaaaagaatcctgattacctgtttgtcatcgaccgaagcgctgccatcggcgaaaaaggaacagcaaaagaagtcatcgaaaatgaaattgtaaaatcaacaaaggcctataaaaacggccatatcacataccttgatccaggctactggtacctgtcaggcggaggccttgaatccgtatctgaaatggtgaaagaagtcgaaaatggattgaaataaaagagcgaggctgccggttcttatccggcagccttttttgtctgttcaaggagaagagggcagagagatgcaaagcgggttttcatgctcataacgccgcaagggccccagactcagttaagcgaatataaaaaaacacgccagttcgattgaactggcgtgacatgatcagcgggccggctggccttgtttgtcggcctgcggcttctttttcaatgtaaacgaaaggataaatccgatcagcgccaagacagcggccacgataaaggcggaattcatgccgtgaatgagcgcatttaacggatgagatgtcgcggcgtttttggctgaattactcatgacggaaatcagaacagccgtgccgatcgaaccgccgatctggcgcatcgtattgttcatcgctgttccgtgcggaatgaggtgcgccggaagggcattgatgcccgccgttgtgagaggcatcataatcatggaagttcccatcatccgcagcgtataaatgacgataataaatgtcagcgaagtatccatttgcaggtccgcaaacgggatggacgtcagcagcaagacggcaaacccgataatcgcaaggccttttccgccgatcttgtcaaaaatccggccgatgatcggcgacatgatgcccattgctatcgcgcccggcagaagcatcaaacccgaatcgaaagctgtcacgtctctgacgttttgcgtgtacagcggcaaaatggtctcagtaccgatcattaatgcaaaaacgatcataccaagtagcgttgttatcgtaaaagtccacgattggaaaacgcgaaactcgagtatcggccttttgattttcaattgtctagagataaagaagaacagggcgaccgcaccgactgcaaaggaaattaaaacagtattgctcccccagccttctgatccggcgttgctgaagccgtacaataaaccgccgaaacccaggctggacaggataatagatatgatgtccactgatgtttctctcaatttcgtgacgtttttcatcagcaagatgacaagcacaagatcaatcagtgcaattggcagaataatataaaataagtatctccatgtaaagctgtcgacgatccagcctgacaatgtcggtccgatggccggtgcaaatgcgatcaccaagccgaccatgcccattgcagccccgcgtttttcaaccgggaaaatcgttaaaaagatcgtctgcatgagcggcatcataattccggcgcctgcggcctgaatgatccgcgccgccagaagaaccggaaagttaggcgccaccgcaccgacgactgttcccgccgcaaagatgctcatcgccgcgatgacgagcgcgcggctcgagaatttttcgatcaaaaaggcggtaatcggaatgagaatcccgtttgtcagcatgaacgccgttgtcagccattgagcttttgtagcgtctatgttcaagtctgccataatatgcggcagtgcggtaaccaggagcgtttggttcaagatcgcgataaacgccccggcaataagcaaacctacgatgatatttctgttgtatgtctgttgttcagttcctgtactcatatcaatccctcttattcttttatactaatcgtttgtatttgtgaaacatcgtattggatggcctcgatttttccaaggtaatcaaggagagccttaattaaatacgtgcggggctctttgctgaaaagctcttcgctcagcaaatctgccgctgacagcagttctgtcacggcaaagtcgtcttgtggcagcgaagaaatcttggttttcagtttttgcaaaaggtcttcaagcaattcctcttttttgggcggtgcccagcatgatgagaaattcgaataggaggcaataatgtcttcatttaatgaacttttctgatcttcgttcagctttttctctatgaagaggtccagaactgacataatgaatggcggaatcgttttaacgtcaggctgcgcttttccagtgccgactaaaaacaggaattccctcatcagcccgtggaaaatgatgacgatatcccatataaacggctcgacctcttcgccgtacgcttgaatgatagagtctttatgccagctgataatcattgattttgtttctttcagatgctttttaaatactgcggtatccggagatgatccctcattggagatgaaattgataaattggcggttttccctgaattccgtaatctccaaagcgatttttttagcgaatctttctttcggcgtcagcgaggtttccgtattgatgacggcgcttttgttcagcatttcatgctttctgaacttgatcaatgccagcagaagatcttctttagattgaaacagtttataaatagatgcttttgacattttgcattcttcagcgatcgcttgcattgcaacattgtgatagcctttttgggcaaacagctttttggcggcccttaagactgctgcttttttttcgttcattccggctccttctttcgcaatgataaaactcatgggtcactaaaaaacccatgagttttcataaatgaaatattaacagaccgaacagtttcggtcaacgattttgttttgggtcacgatgaaggctgatccaatcagccgcttctccgtatgaaagcacgccgtccgtcatacgattgaaggcgccgcggcggatgatgtcttcaccgatctttttcaccagtgacagtgcagctctgaaaggggcggatccgcagctgatcctttcaatccccagttcggaaagaatctgtaaagagggggtgtgtgagccggccagcacgttgatcggcccggatataccttttctcagcccggcaatggtgcctgcatcatcggctccggggataaaaatgcagtccgcgcctgcttgactgtaccgatttgcccgccggactgctgcttgaagacgggagccgggggcgtcagcattgagccagtacacatccgtacgggcattgattaaaacaggaaggttcagttttttaacagccgttattttttcttccattaatgtttcatcacacagcggccgacagggttctttcgttccgtcttcaatattaataccgacaaccccggcagctgcggctttttttgcgttttcagcgactgtttccggtgtttggccgtaacccgcttcaagatctgcactgacgggaatatcgacggcatccgtgatggttttcagtacggaaagcaatgtttcaaaggggagatgttcgccgtcgggatagccgagggacatggcaattccggcgctggttgtcccgactgctttaaaaccgcagttttgaaatgctttggcgctggctgcatcccatgcatttggcagaacgaatgggtctgactgatgatggagatccagaaatgtttgatactttgcaaatgatttcatgtattccactccttttttacatagtgtaaatgtaaagaccttcgatgctcatcgaaatgtggaatggaacgcatggaaaaaggctatcgatcaccgatagcctaaagcatctattcgagtttaaatccttgtttctcaagcatttcacggatgtgaggatagtacactttattgtaataagcggatatgccctgagaccagtttcttgtttcctgtccgttagtccgttttgtcatgtattcggatatttcttcatcgtacgcgtcgatcagcggttttaaatccggttgatacgtttcgctgtgccttaccgcttgttccgggaggcgcggctttttggcggagcggtccgccggatggccgacgacaagtcctgcgacagggaagacgtattcaggaatattgagcagtttgatcaactcttctgcacggccgcggaccgcgccgatcggcacagtgccaagtcccatcgattcagcggctgctgtggccgtcccgagggcgatgcctgcgtcgacagctccgacaagcacggattccattccgtctgtgatcgcaagcgtttcgccgtttttctcaagggcgattttcgcacggttgaagtccgcgcagaacaaaaggaaaacaggggcctgctcgatccagacctgtccgccggccagttcggcaattttctttttccgttcctcatcctgaaccgtaatcacggtgacctgctggccgttaatggaattcggcgcggcttgaacggcttgaataatgtcgtccagctgttcagggctcacgggttcatctgtatagctgcggattgatctatggtctttcaatgttttcaatacttcattcattagaaactcatcctttctttaatccgttgtgtgcgttttaaccacattcaggggttctgataaaaggtcgcccgcggcttgaacgaaagcttgaaaatgctctgtctgattatgggcgtcaagcgcgtcttgatccttccattgctcaagcatgacaaatgtattggcatgttcggtatcttcaaacagctggtactgggcattgccggcttcagctcttgaatgtttaagaagcggttgtacgctttcgagaaaggcgtctcgtttttctggttttactttcatataggcttgcaatacgatcattggatcaaacctccattatgtcatttagaattccttttcgtgtgcgttgtatacacagggaattgattgttcgaaaatcttcgaacaattgaatcgtaacatgtccttgcattgccggcaacccatttgcctccttgatgaattgtcttgaagttaggattatgatacatttaacccatgaaaacaaatgaaatgaagttaacagccgttctccaagccttgagtgatccttacaggcttgagattgtcaaagcattggctgacacagccgagaaaacgtgcggtacgtgcacaaatctcaatattgcaaagtctacgctgtcccaccacttcaaggtgctgagggaagcgggtctgctcaaagtccgcatcgaagggaagcatcattattactccctctgcaaacgggaattggaggagcagtttccgggactgatcgaggcggttctcaaggtagaaaaggaacggtggtaaacggaccagatgtcggctttttaaagccaggctgataccggcaggaaagaacctgccggtatttttaaagcttctcatcaccgcataccgcttcataaagcttggcagtcccttcgtcgatctgatcggcagcgattttggcgaatccgagcacgagcgataccgttccttcatgttttgtctgctctttctttaacgtaaaccgactcatgccgtaaacctcgacccgcctttcctttgctcttaataaaacctcttcttcacttctatccgtttcaaaatcggccacaaagtgaaggcctgcgctctcgcctttaattttgacccggccgttaaagtgtttgacaaggcttccgatcagccttgtccgctttttttcgtaaatctggttcattttcttaatgtgcttttggtactcccccgattcgatcagttcctgcagggcgagctgcgttaagacgctgctcgattgaatcgagaaatggtgcctttttctgtatcgcttcagcagcttttgcggcagtaccatatagctgattctcaggcccggaagaagcgattttgaaaaagtgccgatgtagatgactttttcagagcggtcaaggctttgcagggcggggatcgtatcgctcccgtatttaaattcgctgtcataatcatcttccacaatatagcggtttgccccgtcggaaacccagtttaaaagctgaatcctcctcgataccggcataatgattcctgttggaaactggtgtgaaggcgtgacaaataaaacgtccggattcagacggtgaatctcgctgatccgcattcctttatggtcgagctgaatcgtggcgacttcttttccttcatttttcagcagtcgataaatgcggctgtatcccggctcctccatcgcatagacggctgaggcggggagaaggtcctggagcgtgtgaattaaggactgcgtccctgcgctgatcacgatttgttcggggagacatttgacgcctctcgttaaagcgataaagcgtgcgatcgtttggcgcacttcgtagacgccttgcgggtgcgtcatttctccgagttcgtcaacatgtgaagaaaccgctttctgttcgcagcgaagccatgttttaaacggaaaatgcgccgtatcgacgctcatatgggaaaacgagatccagccgtctttgctttcaggctcttcaaccagttctttttccaattgaaggggaccggggtgacggctggcgtggaacgtttcgatctgctctacaaaaaagccttttctttcacgcgaataaagataaccttctgccagaagctgctggtaggcggcgttgaccgaattgatgctgacgttcaatgtttcggcgagctctcgcttggatgggagctttttccccggcaaaaggttgcggctgaaaatttcttctttaatccgttgatagatttggtgataaatatattccgcgcccttggagcggtcaatcggtattgtgatcatagcgcctccctctggtaccatcaaaaattaatgattggtacttttcatcataccaaaaaatattcagaattataagaaataaaagtgggggagagattttttatgagtcggaacacaaaagcattcacaacggaagattggcaggccaaacgggatcaattcgtggcaaggggtgtctccaacggaaatcgtcatctggccgctaaaggggaaggtgccgttttatatgatattgacggacgccgttttatcgattttgccggggcgatcggcacattaaatgtcgggcattcacatccgaaagttgtagaagctgtcaagcggcaggccgaacagctcatccatcccggttttaacgtcatgatgtatccggcctatttggaattggcggaaaagctttgccggcttgcgccgggcgcccatgagaaaaaagcgattttcctgaactcgggtgcggaagccgtagaaaacgccgtgaaaatcgccagaaaatatacgaagcgtcaagccgtcgtttcttttacccgcggattccacggacgcacaaacatgacgatgagcatgacgagcaaggtgaaaccgtacaaattcggattcggtccttttgcacccgaggtatatcaggcgccgtttccttactactatagaaagcctgaagggatgactgatgaaagctatgatgacatggttattcaggcgtttgacgatttcttcgtctcgtctgttgctccggagacggttgcttgcgtcgtcatggagccggtacagggagaaggcggttttatcattccttcaaaacggtttgtgcagcatgtcgcagccttctgccaaaaacacggcatcgtttttgtcgctgatgagattcaaacaggctttgccagaacgggcaaatattttgcgattgagcattttgatgtcgttcctgatcttgtgacagtgtcaaaatcgctggctgccggcgttccgctcagcggcgtcatcggccgggcggaaatgctcgatgcggcggatccgggtgaactcgggggcacctacgccggaagtccgcttggatgcgtagccgctttggcagtgctcgatattatcgaatcggaacagctcaacaagcgctctgaagaaatcggcaaagccatcgaagagcgggcgcttgaatggaagatgaaatatccgcagattggggaagtccgccgacttggcgcaatggctgcgattgaaattgtccgggacgaaaagacgcgggagccggacaaagcagctgcggccaagattgccaagtacgccaatgaacacggtctgctcttgttgacggcagggatcaacggcaacattatccgttttctgtctccgctcgtcattactgatgaattacttgaggaagggttcggcatcattgaagaagcgctggaacagctctagtttgacatcttctaaaagaaggagcggattttgatgggtaaacagcaaatgaaaaaaacgatgtcgcagacggatgtgctatttttagcgatcggagctatgctcggctggggctgggtcgtcctttccggcgactggatttcgacagccggctttttgggcagcacgatcgcgtttatcatcggcggcatactcgtcatcttaatcgggttaacgtacgcggagctgtcttctgccatccctgaaacgggtggcggcttgattttcgtctacagggcgttcggacgaaaaacggcttttgtcgccgcttggggtgtgctgttcggctatgtttcggtgattacatttgaggcggtcgcattgccgaccgtcatcgattacgtcctgcctgtcgaacatcaggggtttctctggtcgctaagcggctgggacgtgtatgtcacttgggtgttgatcggttcgggaggtgcggtcgtcctgacagcgctcaattacttcggcgtcaagccggccgcgatttttcagtcggtctttacgattgcgattatcgccacgggctttctccttttgggcggcgccttggtaaacggtgatttcgaacatgtacagcccctttttaaagacgggttttccggtatgatgtccgtccttgtcatgattccgtttctatttgtcggatttgacgtcatccctcaggttgcggctgaaattaatgccccgaaaaaaatcatcggcaaaattttgattatttcgattatcagtgcggtcgtgttttatttgctgattgtattcggcgtaacgatgggtctgtcagaaagcgagcttgcgacgacttctttggcaaccgcggatgcaatggtcaatctgctcgggaaccagctgttcggcacggtgcttgtcctcggcggcgtcgccggaatcattacgagctggaacgcatttatcatcggcgcgagccggattctgtttgcaatgtcggaaaagggcatggtgccgaaatggttcggcttcatccatccgaagtataaaacgccgactaatgcaattttatttctgggtgcgctggcgttttttgccccgctgctcggacgccctgcccttgtttggatcgtcaatgcagggggaacaggtattatagtcggatatttgatcgtctcgattgcattcatgaagctgagaaaaacagagccggatttacacaggccgtataaaatcaataagtggaaaacaacgggtatatctgctatcctcttaagtgttatcttccttgccttttatttgccaggcatgccggccgcgctcacatggccgtatgagtggctgatcttggcgggatggacattgatcggttttcttttatacaacagcagttcaaaacgtaaaggggaggagattcaacatgaccagcatgctagaagtatataatcctgcgactggagaaaaaatcaaatcggttccccagcaatccgcaaaggaagtcgaagaagctgtcgtacgctcgcatgaggcatttcaaaaatggtcgaaaacatcggctgcagaacgagcgggcttgctgaaaaaatggtttgatttaattgtggagcagaaggacgagctggcaaaattgattacgcttgaaaacggcaagccgtacgctgaagcgcagggcgaagtcttatatagcgcaggctatatcgaatggtatgcggaggaagcgaagcgcatctacggaagaacggttcccgcctctgtgacgaacaagcgcatcatcgtcacacgccagggagtcggacctgttgcggcgattaccccgtggaattttccggcggcgatgatcacgagaaaagcggcgccggctttggcggcgggctgtacctttatcatcaagccggcgcctgatacgcctttaacggcgcttgagctcgtccgtctcgggcacgaagcgggcattccgaaagacgtccttcaatgtgtgatcggcgacggacaagagatcggctctatttttacaagccatccgctgatccgcaagattacgttcaccgggtcaacacctgtcggcaaacatttaatgaaaaacagcgccgagacggtgaagcatgtgtcaatggagctcggcggccatgccccgctgatcgttgatgaagatgccaacattgacctcgccgttaagcagacgatgctttcgaaatacaggaatgccggacaaacgtgcgtctgtgcaaaccgtctgatcgttcatgaatcggttaaggatgaatttgcagaaaaactccgcgcggaagtcgccaagctgaaagtcgggaacggactcgaagaaggtgtatcaatcgggccgatcatcaataaaaacggcttccaaaaaatcgtcgatcaaatcaatgacgcggtgaataaaggggcgaaagttctcatcggcgccgaatacgaaagcgatgatgagaaatcatgctactttgtccatccgacagtgctgacggatgttgatccttcaatgacgatcatgcatgaggaaacattcggccccgttgcgccgattacgtcttttaaaacgctggacgaagcggtcaagctcgccaatgatacgccttacggtttagcggcatacttctttacggaaaactaccgccgcggcatctatttatccgaaaaccttgattacggcattctcggctggaatgacggcggaccgtcaaccgttcaggcgcctttcggcggcatgaaggaaagcggtatcggacgcgaaggcggactggaaggcatcgagccgtatttggaaacaaaatatttgtccatcggtttggatgaataacaagacaacatgaaaacccgcccgtatatccccgggcgggttttttttacgctttcatctgttcagcgtttattttatcttttttgggctgataggaaatataaaaaatgcctaaaagaagcagggcgatcccggcccaggaaacaagaggcagcgattccctgacaagcacggttcccaacagcgacgctgtaagcggttcagcaagcgacagcgtcaccgccgttgaggcgggcacttttgccaatcctgtcgtaaataacaggtacgcggctccggttgcaatgaccccgatatagaggctgacagccattccctgaaccgatgagatccagccgagatcgtacagaaacaacaacggggcaagcaatacagcgcttaaaaagaatacggtgcctgtgacagcctccggcttttgcttttgcaggagtttcttgcttgtcagcgtgtagacggcaaaggaaagaccggcgccaagtgcgagcagtatgccgagaaagctcccccccgatgaggcggagggaatgaataataaggctacgcctgctatcgctgcagcagttgcgatccaccatttcgtctgcggaacctttttgaacaccagccattcgaggcagccggcaataatcggagcgctgccgatggcgacgaccgttccgacggcgattcctgacaggctgacggctgaaaaaaagaaaggctggtaaaatgccatgctcaatgctgcgatgatcagcgttttaacgggccagccgcttcgtttcaattgaccgcggaaagccgcgaacaagagcagggtgatgccgccgacagccattctgacagcgccgaacacaagaggtgccgcctctttcggcgcaaatgcctgggttgttcccgtcgttccccataaaattgccgcaagcaagacaaacagaaccgatactttcatactaacgatctctccctactcgatcattcagaactttttctattgtaagataagtttgcggatttttgaatcgccgcttcggaaatttccctgaaaagaggaaatattcaacgctggccgaattcatataatggccaaaaaacaattaaagttggaggaagcggatgaaaaaacgaacagttttattcttcttgttgatctggctcgccggatgtgcgagcgcccaagaggctgaggaacaaaccaaatgggtgaacagcgaacagaaagcgattgagaacggcattcgttatgaaagcattacaaaagacgatattatagacaaaatcgatttaaacggtgaacaagtcgtcgtttttcgattcggcgattcggagggagaggggattggcctcgcacacatcaaaagggaaaacggcaactatcaatggtaccgcgacttaaattacgcaattgtaaaatcggaccacccgaaaacggagaatgcggaagcttccgcgccgttcacaacccctaagggaagaaagtacacgttatatacaggggatgcagatcgcctgaatggtacatttgagactgatgacgggcttcatttggagccggtggtcgatcaaaaaacgggcatgtattatcagatcgtgcaggattcggactgaaatgaaacaaaaatgctgtcgggttgttcccgacagcatttcattttttacgatttctttttccgcactgtcaagagcagcgcagcacctccaagaagcacggcgaggatcgacaggatcagggaagcggtttgaatcccttgtcctccttgactgtcttcattttctgcggcagcgttttgtttcgttgaagcgccgtgtgcatcaaccgtttcgtgtccgagttttgcagcgtcgacaatgcttgtgattgcatgcggggtatcggcgtcatcatcaccggtccactcgacaattgtgccgtccttataatattggtatgcgttccaggcggccttttgttctttgtcagggtttttggcggtgaaggtaaactgctggaattcaccaggctgaatgccgccgttttcggcttcccacgtcacccttgttactttttcgtttttgccggtttcagtgcttgttttccaccccggcaccggttcatactgctgaaattcaacaccgtccggcatgctgagaacgaccttgatcgtggcgttgtctttttcaaccggtactttgacagtgtatgtttcccatgagcctgctgctgattcggtcggttttaccgtgacatgtgcgctgaccggcacggagaaaagcaaaaatgatgctaggattgcacccatccataatgtctttttcaacataatcaaaactcctttttattaatttttgcattgaaaactgttctgatttcctcaaatgacgccgttaatccgtgaacgcggatcttccagatgccgtcttcgcttaaatttaaatttttcgtttggaaaacaccgtctttatttttgctgaggctgaacgtgctttccttgtcatccccgaaaagcccggttttctcaacggttaattcaattttttggatatctttgacgacgtctccttttctgtttctgacggtgacttcaaacgtatttgagcccggcatgtttgggctgattcggagtgacagcgtatttccttccgtcagctgcttcgtctcactgaaaggctgcggcagcggcgcgggcggacttggaatattggtgaaaaccgccgtggtcagcagaatgagaagcccgaccgcccattcagctttcatcgaacggccgtcctgctgtttcggcgcttttctaaaacgaaaatagtgaaatgccccgagtccgatcatgagaaggacgagcgccgatttcacaaggagcgcttttccgtaagccgtcccgaacaggttatccagtgtatgaacaatgaaaaagctgttgaaaaggcccgagaatatgagtagccctgctgaagcgagcgcccatggcgagaagcgccgaatggtttcccatatcaaacttttgtcaggcttcagccagtcttttccgaaaaacagcacaaacatcgcgagtccgccagtccaaatggaagcggcattcagatggatgaagttcatcgcgattgtcatatagcctgcgctcgtcgaagcggcatggccgtcgagcgatttgacgaacaatagtccggcaaaaaggaacaggctcaagatcgcgctcttcaggccttttctattcgaagagaaaacaagcaaggcgatgatggcgatgttgatcagccacagcgttccgcccgtcgtattcagaagcgtttcttttaaaagcgaaggctgaaaagccccgatccaggaaacgcctgcgtttgtttttgtttgcagtggcagctgaatgatgatggcagcccctgtcaataagagcgccacattcgtgatccgcttcagacggcgctttttgtcacccggccagccgttttcaggtcggtgccagacgagctgaaaaagagcggctcccatgaacagggagaaaccggtatacaaaaggacgcgttcaatgacgatatcggctgccggcaggcctgatgcttgattttgctgatctttcggcagcccgccttgaatgtttccgatactaaaagggatcgtgcctgatacaggatgaccgtctgcggatacggctctccattcggccgagtagatatcatcctttaacttcggtttcagcttgacggtcatgatctttgcgttttgggggtcgatttccgttttgccggaatctacccgttcacccgacgaatttctgaccgttatcgaatgaaacccgttctgaatcgcttcattgaattcgatcttaatttcttcaggcgcttttttcagctcctgattttcagcaggagttgattgtacgatataagcgtgagcaaaagcggcttttggcagcagaatggtacaaagaacagccagaactgcccagagtgttgctcttttcatcacattcatccaatctcttaacaaaatttcatgtcttcaggctgcagcagctgttcttcatcgttttctggaccagaagcgcggcatcgtcaaacgataacagctgtccgccaaagccttttttgaatttccgcgcttctgcttcagaagcgaaagggagcgcatgcggctcgcagcagttcaaatgaagatctgtatccagcaaaaagacggcagctttggcgctgatcgtcgtatccagcaaaaaatccctgcagataatctgtgatacatcatctttcactttctcatagcggagcattgcgcaatgcacgcagcaaaactgttcaatttggctgtcgtttttgacaatttgcacggcaagcctcgaacctgccccttttccgcaaacgacgcaaagctgcccaagctgctgcttcggcttgtttagcgtaattccgcctgcggtcttgatgacctgcccgttttcaacgagcggtttaatgtcgcggtaaacggtcatttcagagacgttcagccttttcgaaatttccgaaatgcgcagagattcttcttctttgatccaagccaaaatctgctcccttcttttaatcggtagcattctcctcccccgttctttatgttctgtacttataagcctagtagattgaaggaaaagaaacaagcggaacgtgataaaaaatgtgatgaaatgttgaactttaacatcgcggccaaagccgttgaatcgtcgtcaatgggtactggtcaaaccgtcctgtttctaaaattttttgtcaggaaatgtaacaggtttgcacgctttagcgatgcaatgtgaaataataatccggagcaaagctgcagaggggaggggagaaaatggggaaacaaaggcttgttttaataggaaacggcatggcaggggttcgcacggccgaagagatttcactacacggcgggagccggtttgagatcgtcatcatcggcagcgaaccacacccgggctataaccggattctgctgtcttctgtccttcagggagaaacggattggaacgatgtgatgacaaaaagccggagctggtatgaagaaaacgggattaccctttatacaggggaaacggctgtcgcaatcgatacggttaatcaaacggtggcgacagatcaaaaccgcgaaatcgcttatgacaaactgatcattgcgacgggctcttccccgtttatcctcccggttcatggtgcagacaaagaaggggtatatggttttagaacaatagacgattgccgggcattcataaacgcatcaaagcgatttaaaaaagcggccgtcatcggcgggggaatattgggccttgaggcggcgcggggattggcaaacctcgggatgaaggttgatgtggttcaccactcttcctccatcatgcagactcagcttgatccgccggcttctgccatgctccagaaagagctggagcgtcaagggatccattttcttttggagaaagatacagaggcgattttaggaacatcgcgcgccgagggtgtgcggtttaaagacgggacgaagatcagcgccgatctcgtcgtcatggctgccggtgtcagaccgaatatcgaactggccaaggcgagcggtatttcaaccaacagggcgatcatcgtcagcgactatatggagacaaatgttccaaatgtctacgccgtcggtgaatgcgcggagcataacggaacggtctacggcttagtcaagccactgtatgagcaggggaaagtgctggccaaacatatttgcggcctcgaatgttccggttatcagggctccgttcagtccgcggctttaaaaatgtccggaatcgacgtcttttcggcagggaaaatcacagaggacgactcgacgacggctattaaacttttagacgaagcggccggagtctataaaaaagcggtctttcaaggggataaaatggccggcgtcattttatacggagacaccagcggcagccaaaggctgttggaaagcatcatcaaacaaagggatattaccgttgtcaaaaaagagctgtttcaatcggaggaagacagttcagtcgcttctatggcggttcgtgaaacgatctgccaatgcaacgcggtttcaaaaggcatgatcatggaagcgatacagacgcacggtttaaagacggccgaggaggtcaaacgctgtacaaaagcttccgggtcatgcggcggctgcaggccgttggtcgaggaactgctcctccataccgccgaacatgatggtcacatatctgcggcggaacaaccgatgtgcgcctgcacttcattcacggaagatgaagtcgtgaacgaaatacagatgagaaatctttcttccgttcacgaagtcatctcggcgctcggctggaaaaatagcagcggatgccggatttgcgtgcccgcgcttcactactatttaaaaatgatccgtccggacatcgcctatgaggagcacgaagaggagacggatgccatcatcccgcaaatgtacggaggccggacgaatgccgaagagctgaagcgcattgcaggagtgattgaaaaatatcaaattcaagaggtgtacatgacacaccatcagagattaaagcttgccggcatcaagccggagcatatagagcgcgtgaaagaagaactcggcatgccgtattgcctgccgcaacagcagcggatcgccgcggttaaaacgtgcccatgcggatcaccgcagattcaaacattggcagcagacttggaaaaagcagcagaatccctcctcattccggccaaggtctccattggggtgtcgggctgtttggacgattgcgtgtacgcttcagttcatgacatcggacttctcaaagtaaacggaggatgggagatttatgcgggcggccaaggaggacagcatgcttccccgggagagctgctttcagtagccgactcggcggaggaagcgggtgaactcatgaaaggcctgcttcaatattaccgcgaaacagcaaactatcttgagaagatcgggcattggattgaacgcgccggcatcattcatatccgggaagttttatttgacaacggacttcgcggccagctgttcgaacggcttgaaaaagaaaagcggctggctcagcaagaaatgataaaagggctgatgtgaaatgacagaacgattgctaaagtactttcgcacaaagcaaaaagaagtgcaatccgaaaaaacgtatgacacccaatgtccattttgcagcatgcagtgcaaaatgcagctcattgaacagacgattgtgacaagaaaaaaatacacggcggtcggaaaagacaatccgacgacaaaggggcggctgtgcatgaaagggatgaacgcccatcagcacgcgtttcattcagagagaatcacccatccgctgatcaaaaaaaacggcgaatttgtccgtgtatcatgggaagaagcgcttcagtacatcaaagaacaagtaacagcgatccagcatgaagacggccgcgatgctttgagtgtatacggcagcgcgtccattacaaacgaagaagcgtacctgctcgggaagttcgcccgcgtcgccttgaagacgaagcatattgactacaacggcaggctttgcatgtcggcggccgcaacagctgcaaatcaaaccttcggaatggaccggggactgacaaatgccctttccgagatcccccatgcaagggtcatcatcctcgcaggtacgaatatcgccgagtgccagccgacgatcatgccgtattttgaagaagcgaagcaaaacagggcgtacatcatcgtcattgatccccgcgaaacggcaacggccaagatcgccgacctgcatttgaaaatcaagccgggaacagacgccgcgctcgcaaacggaatgctgaaaatcatcattgaagaacagctgacagacggagcttttatcagagatagagctgaagggtttgaagaggtcaagcgccatgtagcatctttatcgcttgaagacatttcggccaaaaccgggatacaaatcgagcagatcaaaaaagccgcggtaaaattcgcccgcgaggagacgggaatgctgttcacggcaagaggggttgaacagcagactgacggaacggctgctgtaagaaatttactgaatattctaatatcaacggggaaaatcggcaaatatgcttgcggctacggcgccgtcaccgggcaaggaaacgggcagggggcgcgggagcacgggcagaaagcagaccagctgccaggttaccgttcgattgaaaatgaagccgaccgcgcctatattgcggatgtttggggcataaaagctgaagatcttccgggaaaaggcgtatccgcttatgaaatgatgaagaaagttcatgaaggcgaaattacaggaatgtttttaatgtgttcaaaccctgttgtatccagcccgaccgccggctttgtcaaatccgctttgggtaaattaaagttttttgccgccgttgatttgtttctttctgaaacggcaatactcgcggatgtcgttctcccagcatcatcctatctcgaggacgaaggaacgatgaccaatctggaaggcagagtgacattaagggaagcctcaaagccgtgtcccggtgaagcgaggcatgactggcaaattatttgcgatatcgctaaagcgcttggaaaaggccgctatttttcatatcgatcggcagaggatgtttttaatgaattgagaaaagcgagccgcggcggaattgccgactattcgggcatcacctatgaacgtctgagaaaggaaggcggcattttatggccctgtccagaagaggggcaccctggaacacagcgcctgtttgaatcatccttctcccacccggacaaaaaagcaagaatgtgcgtcgtcccgaacgaaccaaaggtcaaaaaagatgtaccgactgaggagtatccccttattctgacgaccggaagggtgatgtctcactatttaaccggggtacagacgagaaggagcgctgcgctcaaggcgagacactttgaatcatttatggaaatccatccgaaaacggcggaaaagtacaatattggcgaccgggtgctggtcagggtggaatcaaaaagaggcagcatcatcgtcaggagcaaatggtcggaagccatcaggccggataccgtttttgtaccgatgcattgggcggattcgcaaaatgtgaacgatttgatagcggaaacgctcgatccgtcctgcagcatgccgggatttaaggtttgctccgtgaaaattcgtccgtcagttgacaattttgtgaataaattgtcataaaaagtcataaaaagtttacaaaattaactataatttgtgatagttttaaagatgtaaatagaatacttgtttagggcgtatagtgaattgttttgaaaaaggggaggatcatagtgaaaaaaaagcagcttgtccttgtagggaacggtatggccggggtcagggccattgaagaaattcttaaaatttcaaacgaagagtttcagatcacgattttcggcagcgaaccgcacccaaactataaccggattcttctttccaaagtgcttcaaggagatacggatgttaaggacattacactgaatgattgggattggtatgaagaaaacggcattcagctgtatacaggtgaagaagtcgttaaagttgatccggagtccaaaaccgtcatcacggatacgggaagagtccagccgtatgatgaactgattttggcgacaggttctctcccttttattctgccattgcccggagcggataaagaaggtgtaacagctttccgtgatatcaaggatacggatatcatgctcgaagcttccaaaacgtacaaaaaagcagcagttatcggcggcgggctgctgggactggaagcagcgcgcggacttctcaaccttggcatggatgttaccgttgtccacctcgcgccatatttgatggagcgtcagcttgatgcaaccgcaggacggcttttgcaaaaagagctggaaaagcagggcatgaaatttttactggaaaagcagaccgaagaaatttacggagaaacacgtgtcgaaggcttaaaattcaaagacggctcaacgcttgaggccgatttggtcgtcatggcggtcggaatcaagccgaacgttcagctcggcaaagactgcggccttccggtaaacagaggaatcgtcgtcaatgattacatggagaccgaagttcccaacatttacgctgtcggagaatgcgcggagcataggggcattgcctacggacttgtcgcgcctctttatgaacaggcaaaagtgcttgccaaaaaaatctgcggcgttgaaacggctccgtatgaaggatctgttttatctacccagctgaaggtttccggtgttgaggtcttttctgccggtgactttaatgaggatgacggagaagacaaaaaagcgctcaaagtgtttgacgaacaggacggaatctacaaaaaaatcgttctgcgcggcaatcaggtgatcggcgccgtactgttcggagacagcagcgaaggaaacaggctgttttccatgattcaaaaaggagcggatatttctgatacttcaaaaatttcaatcttgcagcctttgaatcaggaagaaggcatgagcttgaccgctgcgatgagcgacgatgagatcgtgtgcggctgcaacggcgtttcgaaaggaatgatcattcaggcgatcaaagagcagggatgcacatcgacggatgaaattaaagcatgcacaggcgcatcgcgctcttgcggaggatgtaagccgcttgtcgcagagattctccagcatacgctcggctcagaatttgatgcttcagcacaaaaagaagcgatttgcggatgtacggacctttcaagagacgaactcgtggccgaaatcagagaaaaagggctgacccatacaaaagaagtcatgaacgtgctcggctggaaaacggcggaaggctgttccaaatgccgccctgcgcttaactactacctcggcatgatcaatccgaaggaatatgaagatgaaagagaatcccgcttcgtcaatgaacggatgcacgccaacattcaaaaagacggcacatattcagtcgtaccgcggatgtacggaggggtcaccaattcgaatgacttgcggcgcatcgccgatgtcgtcgacaaatatgaaattcctctagtgaaaatgaccggcggccagcggatcgatctgatcggcgtcaaaaaagaggatcttccgaaagtatgggctgatcttgacatgccttctggatttgcttacggaaaaacgctcagaaccgtaaaaacgtgtgtaggcgaacagttctgccgcttcggaacgcaagattcaatggctctcggaattgaccttgagaaaaaatttgaagggctctacacgcctcacaaaattaaaatggcggtttccgcttgtccgagaaactgtgctgaatccggcattaaagatatcggcgttgtcggcatcgacggcggctgggaaatttacgtcggcggaaacggaggcacacatctgcgtgcaggcgatctgttaatgaaagtcaaaacggctgaagaagtcatcgaaatcacaggcgcatatctccaatactatcgtgaaacagccaactatttagagcggacatctgcatggatcgaacgtgtcggcttgtcccacgtccaatccgtattgaatgataaagaaaaacgcaaagagctgaatgaccgcatcaatcaagcgctgtctgtccataaagacccgtggaaagactttttggaagacggaaagacaacaagacagctattcgaaaatgttgtcacttcctaaaatgaaaaaccaacttgaggaggaattcacatggtgaacaagaacttaacaaaggtgtttgtttcgaaggtcggggatttgccgaatcagcttgggaagacagtgctcatcaaggacaaggaaatcgcggtattcaagctttcaaacggcagcgtccgcgcgattgaaaaccgctgcccccacaaagggggcgtgcttgccgaaggaatggtaagcggcgaattcgtcttctgtccgatgcacgactggaagatcagccttgaagacggcaaagtccaagagcctgacacggggtgtgtgcagacatacgaaacggtcgttgaaggcgaagatttgtatatcgtttattaaacggcgcaacaagcgaaacgcaatatttcaaaagccttaagggtcgcagaacgtgacccctctttattaaaaaaacaaacgcgttcacataatcggcagatggaaggatgacagttgatggggaatgggaaagtttattttgtcggggccggaccgggcgattcaggattgatcacattaaaaggaagaacgctgatcgaggcggcggatgtcatattgtatgacaggctcgtcaattcccggctgcttgagcatgcaaaagcatcatgcgaatttgtctactgcggcaagctcccggaccgccattatatgaggcaaagtgaaatcaatgcactgctcattgaaaaggggctgaaaggcctcaaagtggtccggctgaaaggaggagacccgagcgtgtttggcagagtcggggaagaagcggccgccgtcagcgaacacggcatcccgtacgagatggtgccaggcattacatcgggaatcgccgctcctctttatgccggactgcctgtgacccaccgcgatttcgcttcatcctttgccgttgtcaccgcccatgataaatcgggcaaaccggagatgaattgggaagggctggccaagggcgtccaaaccctcgtcttttacatggggatcaaaaaccttggttatatatgcgagcagctgatgaaacacggcaagtccccccttgttcccgcaatggccatccaatggggcacatggggccggcagcggagtgttaaagggacattgcagaatatcagggagaaaataaccgagcatcagatcaaaaatcccgcgattatcgtcatcggcgacatcgtatcattcaggcagaacagctggtttgaagaaaagcctttgatcgggctgaacatcatggcagtcaaaagctgtgaagaagaacaaattccagtggaggcgcttcgtgaacaaggcgctgaagttgtggaatggccgaaatggaaatcggccgaaacggtgcctgacgatgcacttttaggtcgaatcgcttgttttgacagcctgctgttcacctcaagtgcgtcactgcgcagatttttcagccggcttgctgctttgaagatcgatgtcagggaaatgcgcggaaggctttacgcttcagatcagcatgtaaaagcagctcttgaagaacggggatttgaagcctttctgcaaacggaaatgccggtctcgggcagctgtttgctgatcggcagccgggaagccgtgcaaaattacccgcactccgggtgcgaggtattgattacacatgacagggtgatcgacagccgctttacctcgatcatcaaacgggaaattgatgagtttcctattgatatagtgttgttttcaaatcgaacatgcgtcgagctgttcgtaaacgaggcggagacagtcggcctccatccggaaaaaacggctgcccgtcttcaggcgttctgcctcactgaagaagcgggggagagagctgcagccgtagggtttcagcgcgttcatgcagtgaatgatcgcgatcgcctgccggatgtcatcaaagagatcaaccgaacagccgaatttgtctgtcagagctgaaaaaagcagggggaaccctgcttttttagcgtgcggcactgcttctgaacaacacctcttttaagtagcaaaggtctgcctctatatgcttcctcattgattcggctgcttttgcgtcatttctgtcctgcatgtgacgcagaatctcctcgtgctgattgatgatttcaagagtgcgctccggtttttcaaggtttttgctccggtagaaaaaggtcagcgaccgtaaatcaagcagctgtttttgcaggcgttcgttttcgctcgcttcgatgatggcatcatgaaattgcgtatttaggcgaagcagagcattagccgactccggaccttggcttttctggtgcttatgcgcctcagagagcgtttcggaaatgagctccagtgtttcattagaggcaaggcgagtcgccaaagaaacggccagggattcgagcgcctgacggcattggtatatttcttcaagatctttgattgtcggttcataaactgtaatttttgatttatcatctatcaataacaggccttcttgttcaagtgtccgaatcgcctctctgacggggctgcggctcacttgcagctccttggcgattttggattcatagatccgttcgccgggctgatatcctcctttaataatcatatcttttaaataatgatggacttgatcatgataagagactgcacgttggatcgaaaacttcacgctgttcacctcgtttatttttcactgcggaaatcactaatagtctagcaaaaagagagaaataccatcaatctaaaattaccataatattgagtattttgtgacaaaaaagtgttgactgccattagctgtccgttataattaagttataactgtcgacagtcggcagattactttttgattattattgtaagcgctttatcgttagaggggaagggggagttttttatgaaatcaagcgttgtgtcagcatgggatatgctttggagatcacaccgggaagcaaagaggctgcttttgttcgccatgcctgtcagggcgggaaaagatgccggtttaaagataaattcggaacaaaccatgaaggaagagaagccgccgagctataaaacgcctcaaaaaatcgggctgctgcttggtcctgcattgtttttcgctgtccttttgttcttttttcccgagggtctgagctatgaaggtagaatggtattggcgactactttgtgggttgcggtttggtggattacggaggctgttccgattccggctgcatcattgctgccgatcgtgctgcttccgctgacgggggcgctggaaggggcagctgtcacgtcgagctacggcgatccgatcgtctttttattcttagggggcttcttgattgcacttgcgatggaacgttggaatctccataaacggattgcgctcaatattatttctgtagtgggcacgagcacctcgaggatcgtcctcggttttatggcggccacaggatttttgtctatgtgggtctcaaatacggccgctgtgatgatgatgcttccaattggaaccgctatcattcatcaggtatcagctgtcataaagtctgaaagaaaagatttagccgcagaagaggcgaaattttcaaaagcgctgatcttcagcatcgggtatgcggggacaatcggcggactcggtacgctgatcggcacgccgccgaacattattttggcggccaatattaagaagctgtacggagttgaagtgtctttcggcggatggatggcttttgccgttccggtcgtcgtcattttgcttgtagcggtatggctgtacttgacgaaagtggcgcatccgatcaagatgaaggagcttccgggcggaaaagaattgattctcgaagaaaaaagaaagcttggaaagatgagttttgaagaaacaatggttctgctcgtcttcgggtttgccgcgtttatgtgggtgacgagaacgtttttatgggatgacaaaataccgggtattgacgatacaatgattgcgatattcgccgcttcattgctcttcttgatcccttcgctcaataaagggggcagggtattggactggtcggtatcgaaggacttgccgtgggggattctccttttattcggaggaggcttggcgctcgcaacaggttttaaagaaacgggtctggcggagtggatcggcggaaggctgacggtattggatggatttaactttgtggttattgtcatcatctcaacggcattggtgctgtttttgacggagattacgtcgaatacggctacggcgaccatgattctgcctgtactggcctcgctcgctttagcgctgaatgttcatccgtacgcattaatggtgcctgctgcaatggcggcaaactgcgccttcatgctgccggtcggcacgccgccgaatgcaattattttcgcatcgggcaaattgaagatcagcgaaatggttcgaaccggctttgtcattaatattttcacactaattttaatcgtcggagctgtgttctacattcttccgcatttatggggagtagatctgaccgtcttccccgacaatctgaaatcgaattgatgaagcgaagccggagcttaagccccggcttttggtcatggtgaagcttgcaattgatcgttcagcagccatttaaaaagagaaaaaaatgaaactgctgaaaaaaaagatgatcagcatgaacaaccctgtactgccgcatcgatacccatttctattcatagattgtgttgtagagagtgagccgggaaaatgggtgaaaggctataaattcataacggaaaacgactggttcatcaccgaaaatcaaaaggaaatgccattttcatcttaatagaagcgctggctcagaccgcagcatttactgcgttgaaagaaccggctgaaatcggctttctgtcttcggtgaaaaaagccgaatgcaccggcaaggccgttgtgggagacaaacttgatctatactttgaagtttcccgctataaacgggggtttttattcggcaaaggaaccgcctcagtaaacggaaaacctgcagtgaaagcagagatcggaatttttatggagcaaagtgaaagcgggggagaagattgatagaaataaagcctgtcgcgtttgtggaaaacttgcggactttcccgaaggatgatcattggggcgatgtgatttctgaaattaagttggctgaaggcatccatccggacgctttaaaagggatcgaagaattttcccatttggacattatcttttactttcatcaagtaaaagaggaacacattcaatataaggcgaggcgcccgagaaacaataaaaactatcctgagacaggcattttcgcccaacggggaaaaaacaggccgaacaggctcggcgcgaccgttgtcaccctccttgaaaaatccgggagcaagcttgtagtgaaagggttggatgcgattgacggaacacctgtaatcgatatcaaaccggtgatgaaagagtttctcccgaaaggacaaatcatacagccgaaatggtcggaagatttgatgaaagtatattggcatgcagctgattgatagaaaaaacctctcaacaccttctgagaggttttttcatgcttatacgataaaaaagaaggatatcagaccaatcttgaagatcggaagtcccatgaattgtgcccaatcggcaaacaaaatgaaagcgctttattatatgatgtcaataagggggtcgcaaaaatgatcaacgagaaacgtcctgctcaattgctccaatatttgctgcgtgtcagagaggcgacaatgcatcagctgattgatcattttcaattatcgaaacggcaaatctgctatgacctggacaaaatcaatcattggctgaccggcaagcagctgcctgaaatcgaatataaaagaaagaacaggctggccgttccggaaacattgcttgaattgcggttctccgaagcctgttcagacatcggccgctcgtttatttttacgcaggaagagcggatcaaggccttgtacatgtttctgtttgtccgcagggagccgatttcatccgctcatctgacacagctattgcaggtcagcaaaaatacggtcatgaatgatgtgaaaaaagcgaatgaggcgctgactccgtttttagtggcgatcaaatatacaagacagcgcggctatcatttaataggaagcgagtttgataaaagagttcccgtcatgcaccacctttcttctttcctgcaaaagccttacggcaaagaaatccttcattatattttaaaaatttccggctcgcgcgatcacaaacaacaagaatttaaaagagcggttgaacttgtctcaaaagaatacgggcttcaactcgtcgaagaaaggcttaatgaatttatctactttctgatgatgtattcgatcagagtggccgaaggaaaaattgtccgttttcaccaggaggagggtgagcttttaaagcaaagtccgctgaaaaacgcagccgtaaggcttgtgaatgagcttcggattcccgttcatgaaacggaactttgctacattttgatccagctgctcggtctttcattcggacagcagccggcgcatgatccgctttatcagctgtgtgaaaaacttgtatttgaatttgaatcaagagcatgcatcacatttcccaggaggcgcgaggtggcggaatctctttaccggcacttgaagccggcatatttcagaatgaaataccgcattccgattcacaatcccttgctcagcaaaattaagaaagagcataaagaactgtttaccatcgttcaaaagctgatgcggcaccttgaagcgctgttgaacaaaccggttccagaggaagaaatcggctttatcacaattcattttggtgcattgcttgagcagccggtgcagtccgggtcatccaaaaagacggcagtcgtcgtctgtccgagcggtgtcagctcatccttaatggtcaggcgccagcttgaatcgttattttcagagattgtcgttgagaaagcgatgtctttgcaggaattcacacctgacgtctttgatcattatgatgccgtgttttccaccgttgagctgaaaaccaaaaagcgatactacatggtcaggccgctgatgacgcccgctgaaaaaagcaggcttgtcaatgaagtgtatcaggaaatgttcggtgtgaagcaaagggagcttttgacagacgaatttcttcacatcctcaagaagcacgccaaaatcatagatgaaaaaggactaagagaatcattgaaaaatattgcatttgttcaaaaagtgacggaaacaagggggaaacgaccagtgctgaaagatcttctgacagatgaaaccattcaaatggccgaccaaatcaaaggctgggaagaagcgattcaaacagcggcaaagcctttgcttgataaggaggtgatcttgaaggaatacacggatgccatgatcgacaatgtcaaaacgatgggaccttatatgattatcggccccgagattgccatccctcatgcaagacctgaaaagggcgtccaaaaggtgggaatgagtctcctgaaactgaaggagccggtctattttttggatgatgagcagtatccggtaaggcttttgttttgcattgcggcggttgaccatacgacacatctgaaagcactttcccaactgacccggcttctcagcaataaagaaaatcaggattccttaaaggaaaccgagtcgttggagcatatcaaacgtttaatcgaagcctattcatccaattaaaaacaggagggataatatgaagatattggcagtttgcggatcaggactcggaagcagttttatgctggaaatgaatattaaggatattttgcaggaaatggggttaatggagatcgaggtggatcattcggatttgagttcagcgtctcctgatcaagcggatttgtttgtcgttgccaaagatatcgcggaaggagcggcccacctgcgcgatatcgtcgtgcttgaaagcattatagacatggatgaactgaaaacaaaactggttaaaacattgcaggaaaaaggagtgctttaatcacagaaaaggaggaactgcaaatgggtgaaagagcgctaaagctgatgatggatgtgttaagccagccggctgtattaattgcagccatttctcttatcggtcttctgcttcaaaaaaagcctgccaatgaaattgtgaaagggacgaccaaatcgtttttaggctttatcgtgatttcagccggggcgggcatccttgttggctcgcttgagccgttcggaaagatgtttcaagccgcctttcatgtgaacggcgtcgttccgaacaatgaagcgattgtcgcgatggcgctcaatgaatacgggacggcaacagcgctgatcatgtttttcgggatgctgtccaacatcttaattgcccgttttaccagattaaaatacatttttttgaccgggcatcacacattgtatatggcatgtttaatcgccgttatactggcggtggcgggtttgaagggcccgtttttgatcggcgtcggagctgtttcgctcggcttgacaatgagtttgtttccggcgatggttcagccttttatgaaaaagataaccggcaatgataaggtcgcgttcggccatttttcttcaatcggttacgctgtgtccgggttaatcggcaaagcggcaggcaagggctcgcgctcaactgaaaaaatccggtttccaaacggcctcggatttttaagggacagctctgtcagcattgcgctcactatgaccatcttgtacgttttgattgccttatttgcaggggcgggctatgtggagcgcgagttgagcggcggtacgcattatcttgtcttctccgttattcaagcggtcacatttgcggcaggggtgtttattattctttcgggagtcagactcgtgctcgcggagatcgttccggcttttaaaggcatatctgacaaactcgtaccggattccaagccggcactggattgtccgatcatttttccgtacgcgccaaacgccgtattaatcggctttttttgcagcttcattggcggcatcaccggcatgctgattctcggagcggccggagccgtcatcgttcttcccggagtggttccccactttttcacaggagcttcggccggcgtcttcggaaacgctgcaggggggatacggggagcggtcttggggtcttttgtcaacggtctgattatcacgtttttccctgtgttcctgctgccggtcatgggtgatttaggctttgccaatacgacattttccgataccgattttgccgcaacaggaatcgtgcttgggcatgcggtgaaactgctgggatctggaggcgttgtaattggaatcgcagcggtagtggttggcgcagtcttgttcggctttaaacgcggaaaggcggaaaagccagatcagaaagtcgaagcataaaggagtgggcaatgatgtcagtaagggaaatcgatatggagcgttttcgtgatcaaatcaggctgctgacattgaaacagcttcatcacctcggctttggacattatggtggcagcttgtcaatcgccgatgtgttggccgttttgtatggaaaggtgatgaaaatagatcctgccaatccgtcgtgggaagatcgggacttctttatcctttcaaaagggcacggcggccccgccttatatgcagcgcttcatctttccggctattttgaagaagatgtgctctatacgctaaaccaaaacggcacagctcttccgtcgcaccctgaccgaaatttaacaccgggagtcgatatgacgaccgggtcgctgggccaggggatctcggctgcagcaggagtcgcgctgtcgcacaagctttcaggacgcgctaaccgcacctttgtcattgtcggcgacggggagctgaacgaaggccaatgctgggaagcgatccaatttgcggcgcaccataagctccgcaatctttatgtgtttgtggatgataataaacaacagctggacggcccgacgaaagagattatcgatccgctggattttgtcagcaaatttagagccttcgggttttattccgaaagggtaaacggacacgaaccggaagcgatttatcgtgcggtcaaaagaggcgaagcccagcgggaaaggccggttgccgtcatccttgatacggtgaagggaaagggcatcccttattttgaaaaaatggagaacagccaccacattagagcaaatgaagagcaaaaccgcatgatcgaaaggatcattttgacgcttgaagaaaaggaagtgagggcatgaatgaggcggcaaatgtagagctggacgctgttgaaatgaggcaggcatacagctcagccgtttatgaactggctcaagaaaacacggacatcgtggccttggaagcggatttgatgagctcgatctccatggacaaagtcaaacggcgcattcccgagcaagtgatcaattgcggtgtcatggaagccaatatgatagggattgcggccgggctttcgttaaccggaagaatcccgtttgttcacacgttcgctcagtttgcgacaagacgctgttttgaccagctgtttgtttcaggtgcatatgccaaaacaaacattaagattctcggatcagattcgggaattacggctgaacataacggcggaacccatatggcctttgaagatttgggactcgcccggctgatcccaaacgcctttgtttatgaagcaagcgatgcggcaatgctcaaatttttgatcaaaaaggctgcggcagagtacggcattcactatatcaggacgatcagaaaaaaggctgtcaggctttatgatgaacacgaaacattcgcagacggaaaagcaaaagttctcaaagatggcagcgatgcggcgctgtttgccagcggcatcatggtcgccgaagctttgcaggcggctgaactgctaaaagaaaaaggaatcgatgcagcagtgatcgatatgtattgcatcaagccgattgatcaagaaacggtggttcgttatgcacaaaaaacgaatgcgattgtcacggctgaaaaccataatgtcataggcggattgggaagcgcagttgcggaagtgctgagtgaacattatcccgcgccgcttaaaagaatcggggttcatgaagccttcgggcaggtcgggacaatcgattatttgaaaaaatcttaccgtttgaccgcagaacacattgcactggcggcggaacagctcgtttaagatttctttgtcctggccgatttttatattagaatagataaaagcctaaaaaaagtggaggtatcttaaatatcgtgtcagtcaaagaaatcgaatcgatgtgaagctagtagctctggatatggatggaacactgttaaatgacgaacaaaccatttctgatgaaaacagaaaagcgattaaagaagctgaggaaaaaggggtttatgtcgtgcttagcaccgggcggacgctgatgacgtgccgggagttggcggagtcgctcgaactgtcttcttttttgatcacggcaaacggcagtgaaatctgggattcgtctttcaacctggtcgagcgccagctgcttcatcccgatcatgtccaaatgatgtgggatttgcgcaatctgcacaacaccgatttctgggccgccagtgtcgataaagtgtggagaggcgagtttcctgaggatatacaagcgtatgaatggctgaaattcggctttgatattccggatgacgacgtcagaaaccgggtcctggaagagctgaaaaagaacaaagaattggaagtcaccaattcaagcccgaccaatattgaagtcaatgccatcgggatcaataaagcggccgctttggcaaaagtgtgcgagcgcctcggctttacgatggaacatgtgatggcggtcggagacagtttaaatgatatcgccatgatcaaagaagccggtttaggcgttgccatggggaacgcccaggaaatcgtcaaagaaaccgcggactggattacagattccaatatcgaacacggagtcgcaaaggcgatcaggcattgggtattgtcctagccgaaaaaagagccgatttgcggctcttttttttgtgcaaaataaaaaatattcatggactgaagcaagctgaaaaaccttgtgaaatcaggtttatcagctaaagtttttaggtataacgatttattttatgtgaggtttcctaacaatatgatgccaagcgggcaaatccttgatataatcaattcaagtttgattattcggaattaatgttccgaaaatcggaacaaaacgagggatatactaaaattcgaccgaatgtgcatcaatatataggggggatttgatgaatcaagttgatttaaactgcgatcttggagaaagcttcggcgcttataaaatcgggctggatgaggagattctcgagtttgttacatcagccaacatcgcttgcggatttcatgcgggagaccctggcgtcatgcgcaaaaccgtcaaaatggcggcggaaaaaggcgtgaaaatcggcgcgcatccgggacttcccgatttagcgggattcgggcgccgcaatatggcgatcacgcctgaagaagcatacgatcttgtcgtgtatcaaatcggtgcgctttcaggatttctaaaggctgaaggcgtgaccatgcagcatgtgaaaccccatggcgcactatataatatggctgcgcaaagccgggaactgtcggatgcgatcgcgcgcgcagtttatcaaacagacccggaactgattttattcggtttggcgggaagcgaacttgtgcttgccggtgaaagagccggtttaaaaacggctcacgaagttttcgccgaccgtacatatcaagaagacggaacgctgacttcccgccgccagaatgatgcgctgattcaagatgacgatgaagccgtcggccaggtgatccgcatggtgaaagaaggcaaggtccgcagcctgcagggaacggatgtcatccttaaagcagatacggtgtgcattcacggtgatggtgcacacgcgcttcagtttgcgaaaaaaatccgccgcgaactcagagcagcagatattaaagtacaagctttttctacatgatgttgacaaaaggaggaataccatttgaaacaaaataaaaaaacaaaagcgccggcaggcaactggacgttgcttttgggcgccgcttttttaatggccacatctgcaatcggtccgggatttttaacacaaaccacagtatttacacaatctttggccgcaagcttcggctttgtcatcctcgtttccatcattttagatattttcgcccaaaccaatgtgtggagaattattgcggtttctgaaaaaagagggcaggaaatcgccaacctcgtcttaccgggactcggctattttatcgcctttcttgtcgttctgggcgggcttgccttcaacatcggcaatatcggaggcgccggtctcggcatgcaggttttattcggcatttcgccgcagatgggagccatcatcagcgccgtcatcgcgattttgatctttgtcattaaagaagcgggaaaagcgatggaccggtttacgctgatcgcaggctttgtcatgattttactgacggtgtacgtcgctgtcaccaccggacctccggtaggggaagcgataacgaagacggtcatgcctgataacattgattatcttgcgattataacgcttgtcggcggtacggtcggcggatacattacatttgccggcggacaccgattgcttgatgcgggtgttaaagggaaggatgcgatccctgaagtaacgaaaagctctgtttccggcattttgatcacgtctgtcatgaggattgcgcttttccttgccgtacttggcgtcgtatcaaaaggtatgcagattaatccggataatccgccggcatcagtattccagcatgccgcaggaaatgtcggatacaaaatcttcggcctcgtcatgtggagcgctgctattacatccgtgatcggtgctgcttatacgtcggtatcattctttaaaacgttttctccgaaaatcgaaaagaattcacgcggcattataattgtctttattattgtatcaacgctttgctttgtaacaattggaaagccggtcaaccttctcgttcttgccggcgcattaaacggcttaatcttgccgatcgcactaggctcccttttaatcggcgcgcataagaagaatgtcatcggcgactacaggcatccgatctggcttacaattccgggcattctggtcgttattgtcatggccatcatgggaggctatacgttaatcaatgaaattcctaagttatggggatgatctcgttgcatgtaaatgaaatgcgtcctgacgaagtcagggctctgattcgaaaaggggaaataacgggtccgacagccggcatggccgggggttttacccaggcaaacctggtgattttgaaaaaagagctcgcttttgagttcttgctgttttgccagcgcaatcaaaagccgtgtccgattcttgatgtcacggaccccggatctccggttccgtccatcacggcgccggacgctgatatccgcaccgattttccaaaataccgcgtatacaagcgtggcgaattggcggatgaagtgacagatatctcttctttatgggaagacgacatggtcggttttttaatcggctgcagctttacgttcgaacaagcgttaatgaataacggaatccctgtcagacacattgaagaaaagcgaaatgtcccgatgtatcaaacgaatattccttgtgtcccggcaggccgttttcaagggcctatggtcgtcagcatgaggccggttccggaagagcaggcggtgcgagccgttcaggttacatcaaggcttcccgccgttcacggagggcctgtccatatcggcagtccagaagccatcggtataacagacatcgcaaaacccgatttcggcgatgcggtaacgataaaaaaaggggaagttccggtattctgggcttgcggcgtcacccctcaggcagtcgcaatgcacgcaaggccggagctgatgattacgcattcgcccggccatatgctggttaccgatgttcgggatgaacaatttggtgtgttataggatttcaaaatcaatacagagcggtttatctgtattgatttttaatttaaggggatgaaaggcaaggtgaaacagaattgaaaaatctttcgaatgcgacaatgtctccgctcggcgactccgcggttatcatccagcttggagaggggataagcgaacagacgcaccgtgtcgtcagcgcgctgacaaagcggattgaaaacgatccgtttcccggttttattgagtgtgtgccggctttcacgagtgtgaccgttttctatcagccatttgaagtataccgcaagatggagagcggcaaggctgttgattctccgtatgaaaaggtaaaagccctcctcgaccatcatctccaagagctcacaatggaagaagagacagatcagcgcacggtggaaattccggtttgttacggcggccgtttcggccctgatttggaggaagtggccgacatcaacggcctgactgcacaggaagtcatcgatattcacacctcgggtgagtacctcgtttatatgatcggctttgcgccgggcttcccttacctaggcggaatgtctgaaaagatagccgcaccgcggcggtcatctcctcggacttcgattcccgccggttcagtcggaatagccggcatgcaaacaggcgtctatcccctttcaacgccgggcggctggcagctgatcggcaatacgccgcttgaattattcaagccttatgaacagcctccgagccttctgagagcaggggatatcgtgaaatttgtcagcgtgacagaagaggagtatcacgcgctgaaggaggggaaatcttgagcatagaagtgttaaagccgggtctgatgacaacggttcaagacttgggccgcacaggttttcaaaaatacggcgtgcttgtcagcggtgccatggatgccgattctttgcggattgccaatctgctcgcggggaacagccagaacgaagctgcgcttgaagtgacgctgatggggccggggccgtctctccgctttcaaaaacctgctcttatagcggtgacgggcgctgacttttcactgatggtaaatgacgaagaagtcccgctttggcgcccggttttcatcaaagagggcagcgtgttgacattcggcatgtgcaagcgcggaagccgtgcatatatggcagtggccgggggaattgatgtgccgcctgtaatggaaagcaaaagcacatatgtcagagcaggactcggcggctttcaaggaagggcgcttcaaaagggagacgtgttatcgctaggcagcccgacgccgttgtcggaagcgctgcacagaaagctcgcagacgagggcaaagaacggggctttgcggctccgaagtgggctgtcgaccgcaaatattttctcccgctaaaaaagaacccggtcattcgtgtcatcaaaggcgatcagtttgcttgctttacctcatcatcacaagagcgctttttcgcgggtccattccgggtgacggctaaatccgaccggatggggtaccgtcttcaaggagaggcgctcgaactcactcagcctctggaaatgatctctgaagcggtatcattcggaacgattcaagtgccgcccgacggcaatccgatcgttcttctcgcagacaggcagacagcgggcggatacccgagaatcgcccatatcgcatcagctgatttttctcaggtcacgcagatgatgccgggcgagcaggtgcagtttcagcttgtcagccttcaggaagcagagcgcgtttacatcgaacgggagacgaaaatcagcgaactttctgcccgattgaagcttgaatacatgttatgataggtgtgatgtgtatcaggagggggaaggcatggaacataaaaacaaaacagtcgtcaaagccatgaccctgctcaatctgttcctgacgagagaaaggctctcgctgggcgacatgattgagctgacaggcatgccgaaaacatctgtctaccgcatggtttgttctctcgaagaaatgggttttctcgaccgcgacgagaacgggatgtatagcttaggactgctgtttttgcaatacggccaccttgtttcagaaaggcttgatattcgaaaaatcgctctgcccatcatggaagaactccgcgatgacgtggatgaagccgtccatttaattgtaaggcagggaaatgaagcaatgtatatagaaaaaattgagggcacgcagaccgttcgcctctatacagcgatcgggaggcggtcccctttatatgccggagcctgtgcgagaagcattctgacgtttttgcctgaagaggagcgggatgcctatatcgagcaaacagagctggtgccgatcgcttccggcacgatccgggacaaggctgagctgatccgcattgtggacgagtcgtaccggagcggctgcacggtcagtcattcggagctcgaagactacacctccgcgattgccgcgccgattttcaatcataagcgcgaagtcgcagctgggatcagcatcgccgggtttgaagcccgctttcagaaagaccgtcttccttatttgaccgaaagagtgaaaaaggcggcgcttgacatctcgagaaaattaggtttttaggaaaaaagaaaagtatcctttcgagcctctgccgagtacatatatggtagctgccgcgaaaaaacggcatatcggagggggaaaggatatgacgcttcaatatacggctctcggcgactctttaaccgtcggggtcggtgcaggtttgtttgagccgggatttgtacagcgctataaaaggaaaatggaagaggatttgaacgaagaagtttctttgattgtatttgcgaaatccggtcttgagacgtcggaaattttagcgatgctgaacgagcctttcatcatggaacaggtcaaaaaagcggacgtcatcacgataacgggctgcggaaatgatcttctgcaatcgctggagatatatgaaaaagaaaaggatgaacacgtctttttggaagcttcctcccactgtcagaaaaactactcaggcatgcttgagaagatcagagaaataaagggagaaaaagatacgcgttatctcgtccggcttctcaatttatacaacccatttccgtcaatcgaattagcggacaaatggatttccggctttaacaggcacttaaagcagctagagtccgctccgcaaatcaaggtgatcgatacttatgctgtctttaaaggacgcgaaaaagaatatttgtcaattgaccgtgtgcatccaagcagcagagggtatgaagcgatgtcggaaaagctgagagcggcgggctacgggcggctggagggctgaatatgatgaagaaagaccattccaatcaggaatggtctttttttatgcaattcttcagcgagcagccgaaaacagactaaaaaatgaaactattaaattttgtcacacggctcctgccaaagtgccgttttctttcgattgagcagtcatctgtaagcgttttaatatagaaacagggagccgacattattcgacatcatttttttatcacaggctttaaaggacaacaaaggagggttatgaaatggaagatagacaaaatcaagatttcaaagtaaagattcaacgtttcggaagctatttgagcggaatgatcatgccgaatatcggtgcatttatcgcatgggggatcattaccgcattgtttattccgacgggatggatgccgaatgaagcgcttgcttcattggttgatccaatgatcaaatttttgctgccgctcttgattggatacacgggcggtaagatggtgtacgatcaccgcggaggcgtcgtcggtgcgactgcagcgatcggcgttatcgtcggcgcggacattccgatgttcctcggcgcgatgatcatggggccgctgggcggctacctgatgaaactgacggacaggcttttcaaagataaggtccgttccggatttgaaatgctgatcaacaactttacagccggaattctcggcttcattctggcggtgctcggctttcttgcaatcggtccggtggtgctcggcttaaacaaaacattggcggccggcgtggaagtgatcgtcaatgcgaatctgcttccgctcgcaagtatttttgtagagcctgcgaaagttcttttccttaacaatgcgatcaaccacggtattttgagcccgattggtattgagcaggccgcccagacaggaaaatcaattttattccttttagaggcgaacccaggccctggtctcgggattcttttagcttacatgattttcggaagaggcacatcaaagcagaccgctccgggcgctgcagtgatccatttcctaggcggtattcacgaaatttatttcccttacattctgatgaaaccgctgttaatcctggctgcaatagcgggcggagcgagcggtgtgctgacgttttccatctttaatgcggggcttgcggctgttccttcacctggaagtattattgcggtgctggcgatgacgccgaaaggcaaccacatcggcgtgatccttggtgttctcgtcgcagcagtcgtttcattcattgtagcttctttgattttgaaaacgtctaaagccggcgaagaagatttgacggccgcggcggaaaaaatgcagcaaatgaaaggcaagaagagccaggccgtttctgcattgacttcggctgacgaagcggaagaatcagcggctccgtacgaaaatgtcagcaagatcatcttcgcgtgtgatgccggaatgggctccagtgcgatgggggcatcaattttgaaaaacaaagtcaaaaaagcagaactcgatatcgacgtatccaatacatcgatcaataatctgccggaagatgccgatatcgtcatcacgcataaagacttaacggaacgcgcaaaagcgaagcttccaagcgccagacacatatcggtggaaaacttccttaacagtccaaaatacgacgaactgatcaatcagcttaaaaagtaaagtttgagaacccgtgagcctgaaaatcaggctcacacaacatgtatgaaagagagtgatttcccaatgaaaccagtacttgcaaaagaaaacattcatctcaatcaatctgccgcaacgcaggaagaagcgatcagactggccggaaaggcgctggttgacgccggctatgttaccgcggattatatcgagaaaatgttggagagggaaggcctcacttccacttacatggggaacgcaatcgccattccgcatggtacggaagacagcaagcaggatgttcttcattccggaatatccgttatccagcttccggaaggtgtcgaatacggcgatggcaatattgctaaagtgatctttggcattgccggaaaaaatgatgagcatttggagattttgtcaaagattgcgattgtctgctcagaagcggacaatgtcgaacggatcatcaatgcgaaaaatgaagacgagttaatggcggtttttgaagaaggtgaccaggtatgattgcactgcatttcggtgcggggaacatcggccgcggatttatcggagccttgctctgcaaatcggggtatgatgtcgtgttcgccgatgtaaatgatgccgtgatcaatgaactgaacgataagggccgctataccgtcgaaatggccgatgccggaaggaagcaggaaacgatcggaccggtccgggcgatcaacagtgcgacccagcttgacgaattgtatgatttgatagcgaaagccgaccttgtcaccacagcggtaggcccggcggtgcttaaattgatcgcagagccgattgcagaaggtttgaagcgtcggatgaaaataaacaagcagcctttaaatattatagcttgcgagaatatgatcgggggcagcgctcatcttcgcgaggaaattttcgcccgcttaactgaaacggagcgcgccgcaatcagcgattcagtcggctttccgaactcggcagtcgacagaatcgtgccgatccagcaccatgatgatccgttgaaagtaacggtggagccttttttcgaatgggccgttgatcaaacggaattcgccggaaaagtgccggatattgaaggtgtgacatatgtagcggatcttgcgccattcatcgaaagaaagctgtttacggtcaataccggacacgccatggcggcgtatgccggctataagaaaggtttgaagacgataaaagacgccattcatcatccggaggtccgccaaacggtggcaggcgcgctagaagaaacaggccggtaccttgtccaaacatacgattttacacaggaagagcaccgggcatatatgacaaaaattatcggccgctttgagaatgaatgcctgtcagacgatgtcacccgtgtggccaggtcgccgcttcgcaagcttggcagggatgaccgtcttgtcggcccggcccggaagctttgcgatctcggctttgaacctgtccgccttgcagaaggcattgccctggcgctgcagtttgattgtgccgatgatccggaagccgttcagcttcaaagcatgatcgctgaaaaaggctatgccggcgtgcttcgcgacgtatgcggactcgaagaggatcattctttattcaaactggtaatcagccatttgaaagcatagctttagatagaatcgggagagggcggcagccgggcgggggctgccgaaaacagaatgtatgaacagggcggcgcagatgcaacctaatctagaaacatcagctgtgagctgatgtttcttcacttcttgaaaagtatttgcacagattttaataaaaaattaattagtttgaattgaagattttttgacagcgttttatgatagggataccgtttcaaccgccggaacccctttcaccccccccccccccgcaaaaacgacaacaccggaggcggcgttttatgtatatgacagcaagggaacaaaaactaatgaaataccttttgcatcaaaaccgttatgtcaaagtcaatgaaattgccggctatatagaagtcagcacaagaacggtccaccgcgagctcaaagcggttaaatccgttctggacaagtacaggcttcagcttgataagcagccgggaaaaggcttgaaactggtcggagcctacagagacaaacagcggcttcttgaagatctgtcccgggacagtcatgtcgaatacagtgccgatgaacgaaagcttttgattttatgcgcgatgcttgaaacgggagagccgatcaagctttatacaattgcccatgacttgcaggtgacggcggcaacgatcagcaacgatcttgacgagctggagaagtggatcgctccattcggcctttcgctgatcagaaaaagaggctacggtatagagctgagggggccggaggacgccaagcggaaaatcgtcggaaacttgatggccgacaagctcgatgttcagcagtttctggaaacgatcgaaatgaatattaaaggcaagaacgaagcgccggagaaaatattcggtgtcgtcagccgggggaaattgctgaaagcggaaaaagtgctgtttcagatgaaagaaaagtatggactttctctttccgacagtgcatacatcgctctggtcgtccacttgacgtttgcgatcgagcggatacagctcggtgaaatgatcaatatgaatgaagaagaattgacggatctgaagcgtacgaaagagtttgaactggcgcttgcgcttgcaaaggcgcttgaagatgcgtttcacgtgaagatacccgaagctgaggcggggtatattacgatgcatttaagaagcgccaacaaaagcttcaaaatcgactacagagcggaagatatcgagctggatactgcgctcagaacgaaaaagctgatcgatttcatctcgcaaaaaacgggcatgaatttaaccggcaatcattcgctttatgaaggattaatcgcccaccttgaaccggcgatcatccggatcaaagaaaagatgtcggtgcataatccgttaacagagcaggtcaaaaaagattattttctcctatatatggccatagaggaaggcgtcgaaatatttttcccggaaatccggtttccagatgaagaaattgcttttatcgtccttcactttggatcggcgcttgagatgagcaaacaaaaagtagacatcaacgcgctcgtgatttgttcgagcggaatcggttcatcaaagatgctggcctcgcggttgaaaaaagagcttcctgaaatcgcttcctttgagatatcctctctgatggaactgaagacgaaaaacactgatgcctttgacatcatcgtttcaaccgtgccgatcccatatgaaaacattgactgcgtcaccgtcagtccgctccttgacacggaagatgtgaaacagatcaaacaccagctcacccgaaaaatcccgctcatccttcggaaaaagcggatggcgcccaaaaaaccggagccgtttccagatatgcttcagattgcgcggaaaatcggccattacgcggccggcattcaacatatactgagccattttacggttgaaacgatggaagctgaatcaagcctggaacatacggtcaaacggatttgcggaaccctggaagatcaaggcctggttaaggatgcagggcagatggcggatggactgatgaaaagagaagcacagggtggcctcggaattcccggaacaaccttcgcgctgtttcatttaaaaagtgaagcggccgcggttcccctctttaaagcttatgatctgtccaaaccgttcgagatcaaagggatggacggaagcgccatgaagatgatgcggatgctcatcatgctggcgccggccgatctgtctccggaaggttccgagattctgagcttcatcagctcttcgatgatagaaagtgatgagagcataaaagcataccagaccggagaccgcgagcagctgtacggcatgctgaacgtgctgtttcaccggtttatacaggataaagagtggtgagagccccgggttaacccggggctttcttcatttttatcgcacatggtcatgtttaaacaaaaatttctccggttaaaagtctagtaacatcagctaaagggaggaatcacaaatggatttgcgcaatcagcagacaaacgggcagccggcgcagacgcaagaccgccagcccggcatcgaaagcgtcatgaatccgcgtccgatctatgaggatgaaaattacaaaggaacggataaactgaaaggaaaggtcgcgctgatcacaggaggcgacagcggaatcggcagagctgttgccgttgcctatgctaaagaaggcgcggacatctcgatcgtctacttgaatgaacacgaagacgctcaggagacgaaagcgcgcgttgaaaaagagggcgtcaaatgcctgctgcttcccggcgatgtcagggatgaagctttctgcaatgacgcggttgagcagacggtgaaggagctgggccgtcttgatattcttgtcaataatgcggccgaacagcatcctaaagacagcattaaagagatttccagtgaacagctcgagaaaacatttaaaacaaatttcttctcttatttctactttacaaaaaaagcgattgattatctggagccgggcagcgcgatcatcaatacaacatcgatcaacccttaccggggcaatccgcagctgattgactacacggcaacaaaaggggcgatcaatgcgtttacacggtcgatgtcacaggcgctcgtcaaagacggcatccgtgtcaatgccgttgcaccgggaccgatttggacgccgctgatcccgtcaacgttttcaggggaggaagtggcgaagttcggtacagatacaccgatgggccgtccaggtcagccggtcgaccatgtgggctgctatgtgcttttagcatctgacgattcttcgtatatgacagggcagaccctccacgtcaacggcggagactttatcacgacataaaagggggaagctcgtgtgaaggtgacaaaggaagatgtaattgaatactacgagaaagcgggcattgtgctgaacgacgatgataaagaaaacatccaaatcatggactacggattaaataagctggataagctggggcttcagctgttcgtctatgtcaacacagaccgctactgcgccaaagagctcgtattattccctgaacaaacatgccccgaacaccggcatcctcctgtagacaagcagaaagggaaggaagagacattcaggtgcagatacggaaaagtgtatttgtatgtagaaggagaaaaaacggaagccccggccgttatgccgccggacgaggatattgaacatttcaccgtttggcacgaaattcagctcacgcccggcgaacagtttacgattccgccggacacgaagcattggttcaaagcggggagtgaaggtgcggtggtcacggagttttcttcaacaagcaccgatgatcacgatgtgttcacagatccgagaatttagcgaatgggagtccatctcattcgctttttttcgctcgctccatcacatcaaagccgatgaagtgccgtccgtcatgatcggcaaaataaaattgaacaccgttcacacaaagtgttttgaccgcttcctgtgccgtcggtcgaaaccgccgaacgtgcgtcccgtttaggtaagccggttcaagtttatattttctgccggtcagcgttccaagccgcgcgatttccggagcctcgtcccccggaaattcgacaccgatgatccgctgatggcggtcaaagtctgcagacaaagccgtgtcgccgatatcatctgttgctgataccgatccggcccgcctttccgttaaagcaatgtagcccatatcagcctcggcatcaaacgatatgaaaatattcacgtcaaaaacctccattcaattgtttaatatacaagacattgtggaaaagtaacagtggagacgatacaaaggagggaacctcaaaatggatcagcagcaattgaagaacaaggtgcttgatattctcgatcatcataaaatcggttcgcttgcaacggttgaaagcggcaagcctcattcccgctacatgacctttttccatgacgggctgacgctttatacaccgacaagcgatgagacgcacaaggcggaagagattgataacaatccgaacgtccacgtgctgttgggttataacggcgaaggattaggcgatgcataccttgaaattacaggtacggcaaagctcaaccattcaaaggatttaaaggacaaaatttgggatgaaaggcttgagcaatggtttgacggaaaggacgatccgaacttgaccgtgcttgagattgagccttcggaaatcagactgatgaatgaaggcgaaagcaccccggtcacgcttgacatgtagcactgtgctcaatcagtttgtcataaagggcgaactgtagtataataaaaaacaggaacacgcaaaagagcaaataaatggaaagtaaacttcttttttctttcttagaagatgctaatttcttcctctgacccgcccctaacaggatagagggaaaaaagactttttgtttcacaattcacactggcgcggcttcggagccgcaaggacgaatgagaggtagggctttcgttgtcttgtatcagaaattccatggtgtttactttcgctcggaacgatagatgctgatcttttacgaaattcaaatgaccgcctttggcagcggataataatttatttgctcgaataaatatgataattgagaccgcttcggcttttgccggagcggtttttgatttgccgaaacgtttccgttttaaaaacagtcttacctatagactggaggaaggtaaatggactttttaacatccaaggtgctattgattttttgttttctgttgttgatccattccatcgaaacgctcgcttacgctgcccggctgtcaggcgcgagagtcggatttatcgcatcggctctgtcattatttaatgtgatggtcatcgtctcgagaatgtcaaacatggttcagcagcctgtgacgggaaagcttgttgatgtcgcgggggcggatgcgctttccctcgtcggtagccaatttcggtttttgatctttggttcaaccgtcggcacaattttcggaatgctgcttctgccgacattcgtcgccgtattttcgagagcgattgttcatttggcaggagaaaatggctccgttttgcaagtgtttcgcaaggcgttttcaaaaaatagcttcaagcatgcaaagcattatgcaaaaagaccgagcctggaatatgtgaaagactttcggttccgctatataccgaaacggctgtttgtcttgaacatggtcattacggcgatttatacaatcggcgttcttgccgctctttatgcgggcgtccttgtgcccgaaaggcatacgaccgcggtgatggcctccggccttgtcaacggggttgcgacgatgctgctcgcgctgtttgtcgatccaaaggtgtcggtacttgcagatgacgtagcaaaagggaagcggagctatacgtatttgaaatgggcttcgatcacaatggcagcatcgagggtggccgggacgatttttgcccaagtactatttattcccgcttcttactatatcgcatggatgacgaagtggatgtagtcgatttttgacgaaaagatcaaaattcgataattttcattacattatgaaacaaatgaaaacaaaatattatctttttcgacagggttagacagcttgatctttcttttattaattgcccgctgtttcatcctgtgatagtcttatgtgtggcggtgataaaagtggagagggttagagtaagagtaagaaaaccgaaaagaaaaaggcgaaaaatcataaagcgcctgtttacattaactttgctggttatcatagcagcagcgggttatacctactttgaatacaaaaaaggcttatctgaatctgacggagattttaaagaagacggacagtttgaatttaacggggaaggctctgatcttgatgaagtgaacatcctcgttcttgggatcgattcaagaggggaagaccattcaaggtctgactccatgatggtcatccactataataaaaagcagaaacagcctaaattgatttcgattatgagggacagctatgtcgacattccgggatatgacaagcaaaaagtcaatgcggcttatgcatacggaggcccggaactcgtcagaaaaacattaaaagaatcctttgatttggacattaactattacgctgtcatcgattttaaaggttttgccaaaatcgttgatgcggtggcgcctgacggcatcgaagtcgatgttccgaaaaaaatgtcatacggaatcggcatgacactgcagccgggaaaacaagttcttcacggtgaaaggctgctgggctatgtccggttcaggcatgacagagaaagcgattttggacgggtcagaaggcagcaggaagtcttttcaaagcttcaaaaagaagcggtgagcatcggaaatatcgcacagcttccgaagctgtgggggctcgtcgatccgtatattgaaacaaacattccgaacggcgtcatactctccgtcggcaaagactttttgcttggaagcgtaaaagaaaccaaaagcttcaggctgccggttgacggatcatttacgaacaaagacgatccaaaatacggggcagtccttgatttagaccttgaacaaaacaaggaagagctgaaacgctttttaaatgagtgatcaaaaaatccgccgggaaacccggcggattttactgatcatatttttttagtccccggtcataaaggaaattgccgaatggaacaaatgcggccacaagaccggcagccggccatttcacagaccacctcagcacaaaagttgcatacaacagaacaaacaaatacaaaataaacaatccgccgtgaaccgatccgacaatcgtaacggccatcgggtaatccgcccaatatttaagcggcatggcgatgaacagcaggattaaaagcgacatgccttcaataaaacccatcaaccgaaggcggccaatcggcgtttgcagcatagtatacctcctgtggagtgatagtctacctttatactataaaccaaaaggggacaaatatgacaggtttttctccgattgatttatgcgtctgccggaagcttcattaaagcgccgaagtattgctgggcagtcgtaaaacaaataaatgcggtcaattccgttatttcttcttctgaaaacacttcttttaaaacatcaaactgcctgtctgacacgcgctccctctgcgccaaaaagacctctgcaaaccccatcgcaaagctcgttttctgctgattcggaatctcgggcttccccttggccttgcaatattcacacccgtttccctgagccagcacacggcgcacctgctccttcagttcctttgataaaaagccgtctcctgacagctcctcagctaaagccgtccagcttgacatcaggctttcagagtgtccgagcagccgctgaaacggcgtctctcctctgtctgaaaaattgattcttgtcatatgatgatcacctcttcataatcatatataagcagaagagaaatatgaatttcgaacgaaagaattttcgtgaaaatattaaaataatgaaatagaatggagggaataaagttacatatgaaaattgatgatctcgattttaaaatcatagccgaattaaagaaagacagccgtttatcgatgcgggagctgggcaggaagatcagcctttcggcaccgtctgtgaccgaaagagtcaggcggctcgaatcgttcggcgtcataaaaaaatatacgctggacatcgattaccaaaaggtcggtcttcccgtttcctgcatcattgaagcaacggtgaaaaacggggaatacgagaggtttaaagcgtatatcgaacgcctcccgaacattgaattctgctaccggatcgcgggagctgcctgctatatgctgaaaatcaatgcagagagcctggcgaagatcgaagcgtttatcaatgaaacgtctccatatgcccaaaccgtgacacacgtgattttttcggaaattgaaacaaaggaatcgtgaacattagagatgcatctgtatcatctgttataatataaggatgcatgaacaagaaagtgatgtgatgatggacgtgtctaaaacagttgttttagcagaaaaaccttcagtcggccgtgacttggcccgcgtgctgaagtgtcataaaaaaggaaacggatatcttgaaggcgaccgctatatcgtgacatgggcgctcggccatctggtcacattggcggaccctgaaggatacggaaaggaataccagtcttggcggcttgaagacctgccgatcatccctgagcctttaaagctcgtcgtgatcaaaaagaccggaaaacagtttcaggcggtaaaatcgcagctgatcagaaaagatgtcaaagacatcgtcattgcaaccgatgccggccgggaaggcgagctcgtcgcccgctggatcatcgaaaaagcaaaggtcacgaagccattgaagcgtctgtggatttcatctgttactgacaaagcgatcaaagacggatttaaaaacttaaagaacggcaaagactttgaaaacctttaccattcagctgtggctcgagctgaagccgattggatcgtcggcatcaacgcgacgagggcgctgacaacgaaattcaacgcccagctttcctgcgggcgcgtacagacgccgacgctggcaatgatcgccaaaagagaggaagatattaagaactttaaacccgtcccttatttcggcttgcgcgcagcggtcgacggcatgacgctgacatggcaggacaaaaagacgtcacagacacgcacgttcaacgcatctgtgacgtcgcagcttgcaggagcgctgcaaggcaaaccggccgtcatcgtcgacttgaaaaaaacggcgaaaaaaagctttgctcccggactttatgatctgactgagctgcagagggacgcccataaacgcttcggcttttccgcaaaagaaacgctgtccgttttgcagaagctctatgagcagcacaagctcgtcacctatccgcggacggactcaaggtttctttccaatgacatcgtcccgacgctgaaagaccgtttggaaggcatgcaggtgaagccttatgcccagcatgtggcccggatcctgaagcggggggttaaagccaataaaagctttgtcaacgatgcgaaagtatccgatcaccacgcgattattccgacggaagagccgcttgcgctcggcgcgttaagcgaaaaggaaagaaagctttacgatttgatcgcgaagcgcttcctcgctgttttaatgccgccgtttgaatatgaagaaacaaaagtgtttgccgaaatcggcggagaaacctttacggcaaaagggaaaacagttcagtcgcaaggctggaaagcggtgtacgatttcgcagacgaagatgatgacgaggaagaaaaggatcaaacccttccaaaactcgcaaaaggcgacacgctttccgtccggtctttgacagagacgaagggtgaaacaaaaccgccggcgcggtttaatgaaggaacattgctgtctgcgatggagaatccagccgcatttatgcagggagaagaaaaaaaccttgtgaaaaccctcggagagacgggcggacttgggacggtcgcgacacgcgccgatattatcgaaaagctgttcaacacgttcctgattgagaaaaaaggaaaagatatttacattacttcaaaaggaaaacagctccttgagcttgttccgtcagatttaaaatctccggccctcaccgccgaatgggagcagaagctgtcaggcattgcgaaaggaaagctgaaatcttcagccttcattaaagaaatgaaggagtacgcaaagcagacgatcagagaaatcaaaagcagcaatcaaaagtttaagcacgacaatatcacaggaacacattgccctgactgcggaaaactgatgctgaaagtaaacggcaaacgcggcacaatgctcgtctgccaggacagggagtgcggccatcggaaaacggtcgccaaacagacgaacgcccgctgcccggtttgccataagcgcatggagctgcgcggccacggggaaggccaaacctttgcctgtgtctgcggccaccgcgaaaagctctccgttttcgaaaagcgcagagccaaagacaaaaattcaaaagcgtcaaaacgcgatgtacactcttacatgaaaaagcaaaacaaggatgagccgatcaacaatgcgctcgccgaacagctgaagaagctgaagcttgatcaataaaacgggaagcctgccggggacggcaggctgttttaatttgtccaaatatcacaaaaagctgctgttatgacgcgatgatagaaggagattcactgcgcggaaaaaaccgggaaattcatgtagccgcgcccaggaaaatcggattgaaacatgaggatattctggatgccgatcaatgttgaaatccttgtcagccgctcttgtataaagaccgactccgcctttggaaaatcgccccgcacttttgtggcaggggaattttagcgaagttgagcacagccggaaaacgaagcatgatatctcgattttctcttttgctctgtcgggtttaagaaaagaattgatgtacaatcaataggtcagaaagcctgtctaccgccggttttttttatattaaaaaagtatttacaatgctcgtaaacgggagtatgatctctctataataatccaaaatcgcttaatctaaaaaagagcgggggaaccatttagaggcgtacagcctccggggtgaatccttttaaaggtagggcaaactctcgtgagcccgaatccgtcagctaacctcgtaagcgttaagagagagggagataacctgggaataaaaatccgattccgcaggggcttttgcctctgcgcttttttgtgcgaaaaaatactgaaaaaacagcaaagaaggagaagacaatgatgtatagtgcaataaagcggtttttaatcgggaagccattgaaatcaaaagagcttagagaacaaaagattacaaaaacaaaagcattggctttgctttcctctgacgccctgtcttccgtcgcttacggaacagagcagattctgatcgttttggcggctgtcagttccgccgcattatggtattctctgccgattgccgcaggcgtcatgattttattgacggcattaattctttcataccggcagatcattttttcttatccgcacggaggaggagcttatgttgtatcaagggaaaaccttggagtgaacccggggctggtcgcaggagggtctcttcttgtcgattatattttgacagtagccgtcagcgtttccgcgggaaccgacgccattacatcggcagttcctatgttgcatccgtatcatcttctgatagcgattgtgctggtgcttttgattatggttttaaatttacgagggctgacagaatcggcttcaatattggcataccctgtgtatttatttgtggccgctctcttgattctgatcgcggcaggcagctacaagctgcttaccgggcaaatcgagccggcggagcatgctgcagtcggcacgcctgttgccgggctgtccctgtttctcctgcttaaagctttttcttcaggctgttcggcattaaccggcgtagaggcgatttccaatgcgatacctgcttttaaagatcccgcgccaaaaaatgccgcaaatacccttgcgatgatggggatattgctggctgtcctgttttcggggattacaatgcttgctttcggttacggcatcacgccgaaaagcgaagagacggttgtttcgcagattgcatcggaaacattcgggcggtctttcctttactttttcattcagggcacgacttcaatgattttagtgctggcggcaaataccgggttctcggccttcccgcagcttgcgtttaatttggcccgggataaatatatgccgagaatgtttacggtcagaggagaccgcttagggtattcaaacgggatcatctttctcggtattgcatcgattgtgctgattgtgctgtttaacggacagacggagcatctcattcctttatatgcggtcggcgtgtttataccgtttaccctttcgcagacggggatgtgcttgaaatggatgagggaaaagccggacggctggattgcaaaaatgatcattaatgcagcaggagccgccatctccgctgtcgtgctgctgattttattcattacaaagtttgcgcttgtttggccgattgtcatcttcatgccgattgtcatttgggccttttatgtggtgaaaaagcactatacagcggtgagcgagcagctgagaataacaggcaagcctttggagccgatcaaaggaaatatcgtcattgtacctgtcgcgggtgtgacaagcgtcgtcgaaaagtcggtccaatacgcaaaaaccttgtcagatcaagtgattgcggttcatgtatcatttgacaaagaagaagagaaaaagattgagaagaaatgggaggctcttcaaaacggggtcaggcttgtaacgctttattcctcataccgaagcttgatccacccattggaaaagtttctggaaacagttgaagccaaagcggcgagctacaactactctgtgatggttctcgtaccccagttcattccgaaaaaaagctggcacaacattcttcacaatcagtccgcgcttttgctgcggctgaggctcctgtggaaaaaagacatagttgttgccacgcttccataccattttaaaaagtaaaaaacctgcagagccatgcctctgcaggctgttttttttggcgggtacgctgcaaaacgtttcagcagaaatggaaggaggtatggaaaaaacaaaggaggacgtgatatggcaaacaaaaccgcaggaaaaatagctgcagaactgctgaaggaatggaacattgatcatgtttacggcatgccgggcgacagcgtcaacgaatttatcgatgaattgcggcatgaagaaaacagcctccgcttcattcaagtgcgccatgaagaaaccgctgctctcgctgccgcagccgatgcaaagctgacaggcaaaatcggcgtctgcctttcgatagcgggcccgggcgccgttcatctgctgaacggcttgtatgatgcgaaagctgacggggcgcctgtgcttgcgattacaggacaggtgtcttcggatgaaatcgggagagattattttcaggagatcggtcttgaacgaatgtttgaggatgtggctgtctttaatcagcaggtgcattcggctgaagccctgcctgaccttttgaatcaggcgatccgtaccgcatacagccaaaaaggggccgccgttctgagcgtatccgatgatctgtttgcagaaaagattaagcggaaggcggtttatacgtctgcgctttatatcgaaggcgatcttgaaccgaagaaaagccagctgatgcagtgtgcacaattgattaaccaggcaaaaaagccggtgattttagcgggacggggaatgaaatcagcgagagacgagctggtcgagtttgcagataaagcggccgctccgatcatcgtcacactcccagcgaaaggggtcgtacctgatcggcacccgcatatgctcgggaacctcggacacatcggcacaaagcccgcatatgaagcgatggaggaaagcgatctgttgatcatgctggggacttcatttccgtaccgcgattatctgccggaagatgccccggctattcagcttgacaacaatccggcgaaaatcggcaaacggtatcctgtcaccgccggccttgtctgcgatgcgaaaaaagggctttttgaactgacgaaaacaattgaacggaaatcgaaccgcgcatttttggaaagctgtatacaacatatgaggaagtggcgttatgaagttgaaaaagacgaacaggtagcgacagagccgctgaagcctcagcaggtgattgcaagacttgaggacgcggtcgcagatgatgcggttctgtccgttgacgtcggaaatgtgacggtttggacggcgcgccattttaatatgaccaatcaggattttttgatatcaagctggcttggcacgatgggatgcggtcttccaggcgcgatttctgcaaagctttcccatccggaacgccaggttgtagccgtatgcggagacggcggtttcagcatgtctatgcacgattttccgactgctgtcaaatacgaactgcccattgttgtcgtgattttaaataatcagaacttgggaatgattcaatatgaacagcaggaaaaagggcatgttaattatgcgacggcgctcgaaaacgtcgattatgccaagtttgccgaagcctgcggcgggaagggcttcagcgtgacaaagcacgaagagcttattcctgctttgaaaagcgcctttcattcacaaaagccgtcgattatcgatgtggcaattgaagacgaaccgcctcttccgggaaaaatatcctatacacaagctgtaaactacagcaaatatatgatcaaaaaactagttgagaaaaaagagctcgacttgccgccgctgaaaaaaagtttaaaaaggattttttagtatgatgccaagggagatcgtcccttggctttataacggtcagatgttaaaattgaatgggtaatattggaatggccgcgtatgttttctttttgcatcaaaacccgtctcaacactgtgaaaagagaggggattgtaacgtgtatcgtttgccaaaaaccaccttcagcaccgttttcatattagcagccggattgctgtggatgtccatcgttcctcagcaggccttcgctcatggttttatcgaaaaaccggggagcagagcggctctgtgcagtgaggctttcggatttctcaatctgaattgtggaagcgtgatgtatgagccgcaaagcctggaagcgaaaaaagggtttccgcatagcggcccggcagatggacaaattgcatccgcaggcgggctgttcggcggaattcttgatcagcagtcggaaaatcgctggtttaaacatatcatgaccggcggagaacacacctttacctggacatataccgccccccacaatacgagccaatggcactactatatcaccaaaaaaggctgggatcctgacaaaccgcttaagcgcgcagactttgaactgattggcgccgttccgcatgacggttcccctgcatctcgcaatttatctcaccacatttatattcctgaagaccgcctcgggtatcatgtcatacttgccgtttgggatgtggctgatactgaaaacgctttctatcaagtgattgatgttgatctagtgaacaaataaagcctggacttttcttgatctgtttggaaaaccgatttgtgaatcagcgggttttggtgcaaacagagaaaataagcgatcaaaaaccccggctctccaaaatgtttatattatcgcggggtggagcagttcggtagctcgtcgggctcataacccgaaggtcgcaggttcaaatcctgcccccgcaaccaaatataatttgcatacaatcaaacaaaataaataaaaatatggtccggtagttcagttggttagaatgcctgcctgtcacgcaggaggtcgcgggttcgagtcccgtccggaccgccatgttgcacacaaacgaaatcttcgaggttttcgtttttttttatgtcttttttcaggtcaatgctgaaactcggtttctcttctgacgggatgtgaagctcgaatttctttattccttggataattggtgagaattcgataaactaatgatagtgttttgattggtttgcaacagcaaaggagcaaatgatcttatggacgaatttgaattaattcaaaggattacgccccgttcgctttctcatcgggaaatagaaatcggtattggagacgatgccgctgtttatcatacgaagaacaattatcaggagatcgttgcagtcgatacgatggtcgacggtattcattttttatcatcccattcatcgcctgccgatatcggatataaagcattggctgtgaatattagcgatattgccgcaatgggaggccgacccaagtactatcttgtgtcaatcgccgttccttccggttggggcgcgacggatattgaagccatgtatgaagaaatgaataaactggcgacactatatgaaatggatttaatcggcggggacaccgtatctgcaaacgggccgctcgttttgaccgtaacagcaatcggcgaaattgaaaagggcagatcttgtttaaggagccatgccgagcccggtgatgtcgtttttgtgacgggagaacttggctcatcagctgccggcctgtcttttatattgggccaaacatcggcgagagacgagacgcagtctcaatactttattgagcggcacaagaggcctgagccgagggtggaagcaggtttgatctgttcacgctatcaccatgtggcgcttaatgatatcagcgacgggcttgccagtgaattaaatgaaattgctgaagcgagccgtgtttccattgacatatataaagagttgattccggtccattcggatttacatatattgcacacaaaatgggaagagtgggtccttttcggcggcgaggattttgaactcgtcggtacgatttctaatgatcaatgggaacgttttagtcaggaatgctccgagcatgatgtgcgggttcatcaaatcggccgcgtcacaaaacaaggacaggcggaagtgttttatcatgacggacaggaccgcgttcttctcgaaaaaaaaggatataaccattttaaacaagacaggtgacaagtaaagtgaaaacgttagagtggaaaacgacagagcctgaagagacaaaaaacattgccaggctggcggcaaaatatgttcagcccggtgatgtcatcacattggagggcgatcttggagcaggcaaaacgacttttacgaaagggtttgccgaagggatcggcatcaagcgggttgtcagcagcccgacttttaccatcatcaaagaataccgtgacggctctcttccgctgtttcatatggatgtgtacaggatggaagacgagacggaagatctcggattagatgaatattttgagggagacggcgtctgccttgtggaatgggcgcatttgattgaagagcagcttccaaaagaacgccttgaggtggtcattaagcggcttggtgatgacaagcgaaagctgacctttacacctaaaggcaggcgctacgaaaatctttgcgaggagatcagcaaacatgacgatacttgcgattgatacatccaatttaacgctcggagtggcattaatcaaagacggaaaagtgatagccgagcatatatcccacttaaagaaaaaccattcggtcagagccatgccggcaatcgacgaactccttaaagagtgcggtttaaagcctagtgacctgacccaaattgcagttgccaaaggcccgggttcatatacaggcgtgcggatcggcgtgacgattgccaaaacgcttgcatggtcattaaatattccggttaaaaccgtttcaagccttgaagtgcttgcggcaaacggccgttttttccaaggcttgatttgtccgttgtttgatgctaggcgcggtcaggtttatacgggactgtaccagtatagggacggcaaactccatggattggaagaggaccagaacattctgcttgaagattggctaaaaaagctgaaagccatggatcagcaagtccttttcataggaagcgacaccgggattcacagggaaatgatcgaacggattctcgatgaacaagcggttattgcagaccctgccctgcagcttccaagaccttcagaattggctttaatcggagaacttaaagaggacgagccagtgcacagcattgttccaaactatattcgtctggccgaagccgaggccgtctggcttgaaaaacaaaagtaaacgggtgaagccatgaacacgcaaatggtcatacgcgatatgaatccaaaggatttggaccaggtttttgaaattgaaaaaagctctttttcttctccgtggaaaaaagaatcttttcatcatgagctttttcacaatatgtatgctcattatctcgttctcgaagttgaggagcaagtcgtcggctactgcgggatttggatcgtaatggatgacgcccagatcaccaatattgccgtttcacctgcataccggggccgccgcttcggtgaagctcttttgaaggcggccatgaagctttgccggatgaaaagggcggttcagctttctttagaggtgagggtatcgaatcatattgcacagagcttatacaaaaagctcggctttgagccgggaggaattcgcaaaaattattataccgataatggggaagatgcattattaatgtgggtgagactaaatgaatcataaaaaagatctgtatgtattaggaatcgaaacaagctgtgatgagactgccgctgcgattgtcaaaaacgggacggacatcatctcaaatgtcgtagcgtcgcaaatcgagagtcataaacggtttgggggcgtcgttcccgagatcgcatcaaggcatcacgtggaacagatcacgatcgtgcttgaggaagcctttgcacaagcggacatgacgtttgatgacattgatgccattgcagtaacggaaggaccggggcttgtaggcgctctattgatcggcgtgaatgctgcgaaagcgctcagttttgcccggggcataccgctcgtaggcgtgcatcatattgccggtcacatctatgccaacaggcttgttcaggacattcaatttccggcgattgcccttgtcgtctcaggcggccacaccgaactcgtatatatgaaagagcacggctcatttgaagtaatcggagagacgctcgacgatgctgcaggcgaagcctatgacaaagtggcgagaacgatggggcttccttatccgggtggacctcacattgacaaacttgcgcaaaaaggcgaggcaaatgtgccgctgccgcgcgcatggcttgaagaagggtcttatcatttcagcttcagcggattgaagtctgcagtcatcaacacgcttcacaacgcttcacaaaaaggcgaaacgatagctccggaagatttgtcagccagctttcaggaaagcgtcatagatgtcctcgtgacaaaaacggaacgcgctgcggaagcttatggcgtcaaacaggtgctgcttgccggaggagttgctgcaaacaaagggctgagagccgcgctcgaaaaaacgttcagcagccgtccggagatcgagcttttgatcccgccgctctcgctgtgtacggacaatgccgccatgattgccgccgcaggtacggttgcttttgaaaaaggaatcagaggaaaatatgatatgaatggtcagcctggcttagatctgacgtcttattgaaacctcacgctttgtgaggtttttttacccggaaaaagttattaacaagttatcaacacatatccacagtcttgtgtataatgttaaaaaccttaatttacagaccttttttacctgttagtaatgtgtataaatattatgttatttgtggatattgtgggtaaatcgctttctttcttttaaataaaggatttcaattgtggacaaaaaaaccgctccggcttggagcggctcatcctttattcatttgtagatagtgtttcccattctgataacagctgttcaagctcctcattcagctgttcattttcagagtggatttcctgaaccttctcgtggtcttggaagacgtcgggattgcataggagctcttcattcttttcaatttgttcttcaatggccgtaattcttgtttcgatgtcttcaatcctgcgctgccgctggcgttcttttcttttcagctctttttcttcttcatagctcttttttgcgcccggtttttcggaagcggctttctgacgctcttccgtctgtttttctagttctttcagttcaagctgctgcgcttttttttccgtgtaataatcgtagtcgcctaaatattcttcggctttgtcgcgagaaagctccagtacttttgtcgcaatccggttgataaaatagcggtcatgggacacaaataatatcgttcccgggtaatcgattaaagcgttctccaagacttccttgctgtccaggtcgagatggtttgtcggctcatcaagaataaggaagttcgctttttgcaacatcagcttggcgagggcaagcctggctttttcgccaccgcttaatgcatgtacaggctttaatacatcttctcccgagaacaagaagttgccgaggcaggtcctgatatccttttcattcatctccggataatcgtcccaaagctcgtcaagcacgcgttttgacgacgtcaattcagcctgttcctggtcgtagtatccgattgagacgtgagagcccgtcgcgattgttcccgacaccggctgcagcttttggatcaatgctttcaaaagggtcgacttgccgattccgttcggcccgactagtgcaacgctttccccgcgggtaatgcgaaaatccagtgaacggagaagcgggggctggtcctgatagcttaccgtcaggtcttccactcgcagtacatcgtttccgctttgccttgtaatttcaaagcggaatgacgccgacttttcatctccaagcggtttgtccatgatctccatccgttcaagctgctttcgtctgctctgcgcccgtttcgtcgtcgaagcccttgccaagttccgatcgacgaaatcctgcagcttggcgatttcgtcctgctgcttttcgtaaagctttgtttccctttccagctgctcggcttttaattggagataagagctgtagttcccgatatattttttgctttgggacctggtaatctcgtaaacttgggtaaccactttgtcaagaaagtacctgtcatgggaaacgattaaaatcgctccgctgtagctttgcaaatattgttcgagccatgtcagggtgtcgatatccaagtggtttgtcggttcgtccaaaatgaggaggtcgggttttgtcaaaagcatttttccgagggcaagtcttgttttttggcctccgcttaaatcctgaacgcggacggagtcgtcaaatcccgcaaagccgagcccgtgcatgacggatctgacctctgcctcatattggtagccgcctttgtccttgaactcctgctgaagcctgtcatatgtcttcattaatgattcaagcttgtccggtccggcttgcgccatcttttcctcgatcgcgcgcatttctttttccatttttttaagaaaatcaaatactgacagcaattcctctttaagcgtcagcttggaatcgaggccggaatgctggtcaaggtagcccatcgtcaaatctttaggtttgatgatgtcccccttttcgtatgagagctttcctgcgataatctttagaagagtcgattttccggcgccgttgcgtccgacgaccgcaatccggtcccgagacctgacttcgagttttatattcgttaaaatcgtatcggctccaaacgattttgaaagctgatttacttgtaaaatcatcatgatctttcacctcttgtctgctattttaagtgtagcctatcaccgcgcagtcagcaaacaattaagtgaagtctggaagattttagccaaagaaaaagacagattgaaaaaaatagtgtatgatcattataaggagagttaagaacatgaatgagtttacacattttaatgaacaaggcagagccaagatggttgatataagcgaaaaggaagcttcagtgcgcacagctgcggctgtttcaagcgtgtccatgaatcgagaagtacatgaaaaaatcaaaaaccgcgaaatcggaaaaggcgatgttttggcggtggcgcaagtggccggaatcatggctgcaaaacagacatccgccatcatcccgatgtgtcatccgatcgctctgaaaggagtcgacatcgccttttgctgggagaagaaagagcagaagagcatcctgcatatacaatctaacgtcaagaccaaagggagcacaggtgtggaaatggaagcgttaacgtcggcctccgtatgtgcgctgaccgtttatgacatgtgcaaagcggcggataagggaatggtgataggaccgacctttcttctcgaaaagacaggcgggaaaaacggtgactataaaagggaaaaagctgatgtagacatggaggattagtttatgaacatggatcattcaaaaattccgcaagcgacagcgaaacggctgccattatattatcgttttttaaaaaaccttcatgcatccgggaaacagcgtgtatcttccgctgagctgagcgatgccgtcaaagtcgattccgcgaccatccgaagggatttctcgtacttcggcgcgctcgggaaaaaaggatacggctacaatgtcaattatttgctgtcctttttcagaaagacgcttgatcaggatgaaacgacgaacgtaacgcttattggcgtggggaatttggggacagcctttctccattacaattttatcaaaaacaataatacaaaaatcgccatggcgtttgacatcaatgaagaaaaaatcggaaccgaggtcggcggcgttcccgtctatgacctgaataagcttgaagagcatatgacggatgatgatatcccggtcgccattttgacggttccagctcaagccgcacagtcgattacagacaggctggtggcgcttggcattaaaggcattcttaatttcacgccggctcgcttgaatgtgccggaacacattcgcattcatcatatagatttggcagtggaacttcagtcgctggtgtattttctgaaacattattcaatgcaggaaaagtaaaacggaaaacgaaaaataaataaaggaaagggggcaggctttatgccaacaatcggtcctggaagctttattttaattgtcgtggtggcgcttttgatattcggcccgaaaaaacttcccgagctgggaagagcggcgggaaacacgctgcgggagtttaaaaatgcgacaaaaggtttggctgacgacgattccgataataaaaagaaagaagatcagtaggataggatgacatttatgaagggaaaagaaatgtcgctgttagaacatatcacagaactgcgcagacggcttgtgatcacttttttcttttttgttttgtttgttgcggcaggcttttttttggcgaagccgctcataatctacctgcagcagacggatgaagcgaagctgctgactctcaatgcgttcaagctgaccgatcctttatttgtgtacgtgcagttcgcgttcatcatcggcgctgtcttgacttcgccgcttgttctataccagctgtgggctttcatcagcccggggctgtatgaaaaagaacgaaaagtgacgctcagctatattccaatatcgatcattctttttttaggcggcattgccttttcttactttattttatttccgtttgtcgtggactttatgacgagagtctcagatgatctgaatgtcaaccaggtcatcggaatacacgaatattttcagtttctgcttcagttgacgcttccttttggattgttgtttcagatgcctgtggtcatcatgtttatcacaaggctcggtctcgtgacgccgatgtttttggcgaaaatccgaaaatatgcatattttgtgttgttcgtcattgcggcgctcattacaccgcctgagttattgtcgcatttaatggtctccgtgccattgctcattctttatgaaatcagtatcgtgatttcaagaatatcctacaggcaggcgcaaaaaacaatgattcaagaggaaaatcaatcgtttttgaacgaccatacaaaataagagccattcttttttcagaatggctcttttctttcaaataaaaggctattgatcttttcgcttcatcctgccggccagggcgaacattttaaaggagatgctgatattataggctgcgaaaagcatcagcaggatcgtataaaaagaccacatgcttccgggcgaggttgccgcgagatacgtaaacagcacacccgttaataaataaatcactccccagaatttagggcttctcatcatagaaatcctccaataatcatttgcattttctcgacgtttttcaaatattcttcaataggctcccggaatgtctgcagcaagacgacgagcgtattcatggcgacatgggcgaaaatcgggacgataatccggttggtcctgacatataaaaaggcgaatgtgaatcccattgccgtataaatgagcagatggctgaaatccaaatggacgaccgagaagagcaccgaactgaacagagcggcaacgaaaaaattcgttttctcatagatcgcaccgaaaatgatctttctgaaaatgatttcttcaagaatcggaccgaatacagaagagacaaacaccatcagcggcaatgcggtgatgattttcataatccgctgcgtattttcggattccgggttgaccccgaacaagttcatttcgatcgaagcggcaattgactgcgcaaacaaagcgagaaaaacgccggctaccgcccatccgattgacgctgcaaccgatgcttttggacgattgcgaagcgtcgtcttcggcaccgtccgcaaaatcagcagcacgatgacgagacagagggtaaacgcgatgacagaccagacgcccgtcaatgtaagctgagcttcagccttgggctgtcctctgcccactcccaaaaagtagagaagaggcaagccgacaaccgccgacaattgcatgagaacgtatgccaatataataaaccagtattgttttctcaagctttatgtactccttttctaaaaatctaaatcagactatgtttattgtaacacactctttttaaattataggatgataaggatatgcggagaaatgtaagcgcaaaaaaatttgaccttttcacttgaaattgcctgggagattctttattataagaattgtgttagcactcaccgagtgcgagtgctaaaattacatatgaaaatattgaggaggttgtttcattgttaaagccattaggtgatcgcgttgtcattgagctcgttgagtctgaagaaaaaactgctagcggaatcgtacttcctgactccgcaaaagaaaaaccacaagagggtaaagtggttgcagccggttcaggccgtgtgttagagagcggagagcgcgttgcattagaagttaaaacaggcgaccgcatcatcttctcaaaatatgcaggtaccgaagtgaaatatgaaggtactgactacttaatcttgcgtgaaagcgacattttagctgttatcggctaagtcataaataaaaacgagacaattatataggaggttcgaataacatggcaaaagatattaagtttagcgaagaagcccgccgttcaatgctgcgcggtgtagatgcattggcggatgctgtaaaggtaactttgggacctaaaggacgcaacgtcgttcttgagaaaaaattcggttctccattaatcacaaacgacggtgtaaccatcgcgaaagaaatcgagcttgaagacgcgttcgaaaacatgggcgcaaagcttgttgctgaagttgcgagcaaaacaaacgatgttgccggtgacggtacaacaacagcgacagttctagctcaggcgatgattcgcgaaggtcttaaaaacgtaactgccggcgctaaccctgtaggcgtgcgcaaaggtatcgagcaggctgtggctgtagctgttgaaagcctgaaagaaatctctaaaccaatcgaaggcaaagaatcaatcgcacaagttgcttcaatctccgctgcagacgaagaagtcggaagcctgatcgctgaagcaatggagcgcgtcggcaacgacggtgttatcacgatcgaagaatccaaaggattcacaacagagcttgaagtggttgaaggtatgcagttcgaccgcggatatgcgtctccttacatggtgacggattccgataagatggaagcggttcttgagaatccgtacatcttagtaacagacaaaaaaatcacaaacattcaagaaatcctgccggtgcttgagcaagtcgtgcaacaaggcaaaccgttgcttctgattgctgaagacgttgaaggtgaagctcttgcaacattggttgtcaacaagcttcgcggaacattcaacgcagtggctgttaaagcgcctggattcggcgaccgccgcaaagcgatgctcgaagacatctctatcctgacaggcgccgaagtgatcacagaagatttaggtcttgaccttaaatcaactcaaatcaatcaattgggacgcgcttctaaagttgttgttacaaaagaaaacacaacaattgttgaaggtgcgggagatacagagcaaatcgcggcacgcgtcaaccaaatccgcgctcaagttgaagaaacaacttctgagttcgataaagaaaaattacaagaacgccttgctaagcttgcaggcggcgtagctgtcatcaaagtcggagctgcgactgaaacagaattgaaagaacgcaagcttcgcatcgaagacgccctgaactctactcgcgctgcggtagaagaaggaatcgtatccggcggtggtacagctcttgtcaatgtttacaataaagtagctgcccttgaagctgaaggcgacgaactgactggtatcaacatcgttcttcgcgctcttgaagaaccaatccgtcaaatcgcgcacaacgcgggtcttgaaggatctgtcatcgttgagcgcctgaaaaatgaagaaatcggcgtcggctacaacgctgcaacaggcgaatgggtgaacatgatcgacaaaggtatcgttgaccctacaaaagtaacacgctcagctctgcaaaacgcagcatctgtagcggctatgttcctgacaactgaagcagttgttgccgacaaaccggaagaaaacaaaggcggcgcaggaatgcctgacatgggcggcatgggcggaatgggcggaatgatgtaagcccagcgtccaaacgttgatatatcaaggaaaagaggctctttttagagcctctttttttaaaaaatcacataaaaatcacattttttcggttttaaaacttgtgataccttgtaggaaacatttcattttattaaatgtttctttcttcatcttgtttgttatgtgagtataaatttcaattgtggctctcatatcagtatggccaactctcttcataatctcccccagagtgtttcattatttgacctaactcatggcagaagtctttccagtgctgctccttgtttttaagagactatcgaaaaaaaccacattacttaaacaaaacttaaagatcccacacttgttaggcatgtacctaatttgaatgtctatctatcagcaataactttcatatcgacttgggaaggttctgctatgtttatttatatatatatgtattgaacttcttcttctaattttgaaaggtagtacattaaaatccccctgtataatgaaaactgatgctctctttttggtgatttgaaaacccgattaaacgggtttaaaagtttattttttcaaaacttgaagcgttattgaagtaacgaaaaggagcaggcataatgcctgctcctctatcttgaaactaacgagattcatttgaggatttaaggtaactgatgaacaatggtgaaatgacaattactgttacaattaataatagtctgctagatattaaatttacaaatgtagtgttaataatatatagggctaaaaccattaaataaaaagccacgtaaacataagcatacacttttttgctgaatggttctttcatgtaaatgaaaagaaataaccctgccattaaaactaagaaagtcatattttccctctttcatttttattgtggaaaaaccccagttggaacagctgcatatccgagtccagtaaaacgtattctaacaccatgaccttcatgttcgtcttgaatcatttgaccaaaaccaactagtccgcctccgattactccggaaattacgcttgctaattgtgtaggaggtacgggtataacccttgatattaaagcaagaccagaggttgctccaccgcctgctttaaatggttcttgtttcattacagtcaaaataaagattatatccccaccagtagagatcatgaccagatcgaccgcagccttttttcgctactttcattttatgattgtttccattctccagtgtcaatacactaccgtctttgtctaaaattttcacactaaaatcggagttaatgacagcttctttttgtttcactaaatcgttcaagtatttaatccagtcttgaacttcgttggtgacagaacgtgaaatatctagtttagtataagatggatctaaggtaagagttccatctgcgtttaatttaagataagcttctaatttctttacatcattcatactcacctttacattcttaaattcttcgctgttcagtttttgatcgggtgcagaatttcctttatatgctccagtagtttcagtatgtagtttttcgttgtcagttagttctgacgctgatactatattgaaaatacaggtgaaaccaatattaatgtcagtaccataacaaatgtcttaaaaccattgtgcttcttttctttcacgataatgccacccttcttattatagatcaacctcattttacttgaaaaacaaggtaatttgcggcatgatgtgtataacagtaaaaaagaaccatctgaaatcttgtgcgtaatgaaattatactaggtgtgattaattagaatatggagggctaatttaagaaggaaaaaaacgattaagatgaaggatgttatgatgtaactatgttgatctttggattataggtcttactttatttctctaaaaacagcatcctcaaatttaattaaattggtatctacttccacaatatgaaaaaccttacggatatgatttatgtaatgaatttttccttctatgttaatagtctctcctgattctgctctatttaaaaagggcagcggtttaaatacagagaacagaactgttaaattaaattccattgcttcacatattatcttatccatgtcttctatttgaaccatgtcaagaaccggccttttaaccttgttccgattgctttctaattcgcggagcaggctgaggtgttccgacagcatcatagctgttcatttgattgatccccgatctttcaagttgtcatctttcatggtgtttatctccttgagtttcaatcgtgaattaatggaaacagtgttttagctattttggttacaaaatcggtcacggtttcggaatttgaaggtgtatgcggcatgatgtaagcccagcgtcaaaaacggctgatatatcaaggaaaagagcatctttttatttaacttgcgatgacatataaatacccttttatccatggaataatttccttttgggggattatggtataattagcatctgaatttttaacagaaaggttaaacaattgatgtcgcacaacaaactaatgtttttgctttatcattttcatctattattcacctgcttggtacaatagtggaccctgcggctagctggaagccttggctggtgaacattgcattcattttattggttcttctatttttaaatctcactataaaagaaaatcaacagaacaagtagcggcatgcccttctcaaagagaagggcatatattttatattatgaacatcggtaagagtagccttaataaacgtcactctaattctgcatctgaatatcggagcttgctattgcccgtaatctctttcaacggccagtgcgtcagcaaatggcattaaaaccgcaagacctaaatttgattctttgtgaaaaatgggggattttaaaaagatggtcaaaaaaattgtaaatggattcaattcattttcactactggggacaatcttttttatcggcagttattttacgtacaaatttaatggcgtggagctggtcgggttcctgtacttaggtattatttttttgacagctctgatcgcaaccaccgtaatgttaatcaggctaaaaagaaaaggaatcaataaagataaacaggcttaatgcatgctttatacttattttagcttctctccgctagtgtaaccttttccaatccataatatagatctcttaaaagcatcacatgtccagtacatcaaatgtaatctcctgttcatactaatatcgggaggtacatcgacttatgttgaaaatttggatgactggacttttactattagcgcagcccgcggggcattctgacagcttaacgatcactcagcaagggaagaaagtggccgttgtgaaccgcgaagattttacaatgccgcttcccggaacaccgatgattgatgataaaaaatacaacgaattcgttgacaggcttgaacggaaagtacacaaggatcctgtcaacgccgtgatcaacgatcagggaaggatcgttcccggcaaggttggctacagcctttcccggaaggggtttaaggagcagttttacgcgtatttttatggggatggcccgtccacaatagaagtgcctgaattgaatgtttacccgaaagttgacagcgaactgctttcccatatccggacacagcggatcggccagtatgtgacgtactttaattccgggaataaaagcaggacgcacaatatttctctcgcggcaaaggcaatcgacaatcatgttgtttttcctaatgagacgttttcatttaacaaagttgtcggaatgaggacgccggacaagggatatatgaaggctcccgtgattgtgagaggcgaattgtctgaaggagtgggcggaggcatttgccaggtttcgtcgacattgtttaatgctgttgaccgggcaggactcgaaatcgtccagcgctattcccacagccggcgtgtcccttatgttccgccggggcgcgacgcgacggtcagctggggcggacctgatttgcgctttcaaaacaaatataaccagccggtcttgatccgggcgaaacggcacgggggaacgatggttgtgacgctttattcttctgatgtggtcaatcatcagctgcgaaaagtcccgaaggctccggcccaaattccaaaagaagagcatcaaagcggggatcactaaaggcgaatgttcatctggcgctgcacttgttcacacaatgtacaataaaatccttttgcctgtatgataggatgaatcaaggacatctttaaatttcagacaagaggagatgatcgagtgacatggctttttgtaacctttttggtgatcttcagtctttttaaaatattggtcacttgccttccgagcggtgtcgtagagtggctgaccggcaaatttcaagttcatgtgaagcttgaggaatcgaatgttcaagtgacattcggcggaaaacgtttagagggatctgacaagagtcgatttattcaaaactttaatgaagcggtatttatggagcggtactacatatacccgggagatgagccgctgtatgtcaatccgaaaaacgccgggacaccgtttgtgatcgaaacaactaaaggaaaaaacgctgtgaagctgtttgtatacagatacgatgatcatatagacgtcgttaaacaatataagaaaaagacggccgcttattgtctgcgttctgacagtctgcaaacatgcggggggatgaaaacggcggatttgatttaaaaagcaggaaaaacctgcttttttattatgatatgaaatagagcctgacagcgccgtaaccgatcaaaaataaccaggcagcgattctttctttttgacgtgctgtacggctgtccatttcaccatcgcctttcttcattttattagcaataaaatccttgtattgcatattattctaaattaaaatgaggttgataaaaagtcttgcacagggagaaacgccatgaccatacatattcaacagcttgaagcccctctgaatcgtgagtttgttgatgaactgatcaatttgtggaatgataatacgttggaaacggctgattgtgcattagatgatcaagatagagaaatgatacaccagcagctggaacaatatgttcaatccgcatacggagcggtttttgccgtcgtgaatgagaagcaagaagcggtcggatacgggctggcctctattaagaaagatttggtcagcgattgtctgagcgggcaaatcgatgaagtgtacatagccccggactatcgaagaaataagctggggaagcttgttgcagaccgtatgatggattggtttgaacaacatcaagtctctcacgttcaagtatcggtcgatatcgataatcaatcggcgctgcatttttgggaaggcatcggcttcagcagtgatttttatcttctgacaaattagttttttgaatcaagtgggagcggccttcgttgtcatgcccggccgcctagctaaaaagccccttttaaggggcttttttgatgagctcaggagaattatgatgcggtgaattgacgagaggcgcgacttcatacgcttccatctcttttgacgcatatggttttaaaaggctttctaagtatgcaaggttttgattcttcggattcagccattctttttcagcctggcgatcaagaatgacgggcatgcggtcatgaatgtctttcattaaatcgttgggcgttgtcgtaatgattgtgcatgtatagacgggcttgccgcctgcaggctgccacttctcccaaagcccagcaaatgaaaacagtcgatttgttttgagcttgatcctcatcggccgctttgtccttgcatcggtccgcttccactcataaaaactgtctgccggaatgaggcacctttgtctgatcagcggctttcgaaagctcggcttctccgccaaagtctcagcgcgcgcattgatcattttataaccgattttctcatcctttgaccacggcggaatcaatccccaccgcagccgccctagccggttatgcgaaccgtcgttgatgacggcgagaatatactgggaaggcgcgatgttataactggggctgtaatcttcaatcgccatttgatcaatctcgaaacggtcaataatctcatcaaattcagaaaagagcgtaaacctgccgcacatcttaggtcacctttttttgtttattgaaagtttgaggcttttatatataaatggccaacaaggccgctgaaacagccatgataaagcagtcatcgcccgtcatggccacgccgtttttgatgaatacactgcaggtccagttgagtgccgatccttccgcggtccggtcaatcagttttttacccgctgtgtaaacacatgctttaaataaagaaaacgaaatggaacataaaataaagagcaaaataaactttaccatcaacaccagcattgccttttcaccccggcatattttgtaagccccaccttcattttaccaataaattcatctgttaaaacctctttcttgttttattatattgaccgaatggtcagcaatcgttgcaatttatactaaccgattggtcaataacgaaaaggaatgatggtcaatgcctttacagctttatgaaaaagagcaaatactcgatgcctgtttggaggtttttgcccggcatggctttgcaaagacttcgaccggaatgctggcggaagcggccggcatttcaaaggcgctgatttttcatcattttaaaagcaaaaaagatctgtacttaactgtgctcgattattgtattgagaaggtaaagtcgcgcctttcccttgatgacctggcgtcttatgatgatttctttgaagcgaaagaaaaaataagcatggctaagcttgagtttttcgcggattatccaaatgtatacaagctcacaaaagatgccttttattcaccgccttccgaattaaaaaaagaaatcgctgcaaagtatggggagcaatttgccgttagaaatcgtattctaaaacagctttttgcgaaagttccgttgagggaaggagtggatcgtgaagaggcgttcgaacttatcatggtcatgatggggcattttgaacaaaagtttctagcggaagtaacggctgaggacgattttgatccagcctggagcagacgtcttcttgaagaacgaaaacggtttttggatatgattcgtttcggcattgaaggcgaataaaaagggggattcctgatgggacactatgtattgggctttcatgagatcgatcgaaccgatttgccgcttgtcggaggaaaagggctgaacttgggcgaattgtcaaaaatggacggcatccaagtgcctcccggtttttgtataacaacaaaagcatatgaaaagatgatcggtgaaaacgataaggtcagtgaacagattgatcagctgtctcttttaaaagtgaaggacagaaaacagattaacgatcttgcccttcagatccgcaatggtattgaaagggccgaaatcgccgaagagatcaaagaagcggttaaaagcgctcactcaaatgctggcggcgatgcatatgcggtccgatcaagcgctacggcagaagatttgcctcatgcctctttcgccgggcagcaagatacgtatttaaatataaaaggaatagaggcgatcttgaagcatatcagcaaatgctgggcttcactgtttacagagcgggccgtgatctaccggattcaaaacggttttgaccaccgcaaagttcaattatcggtcgtcgtccagcagatggtgttcccggatgcgtccggcattttgtttacggcagatcctattacatccaaccggaaggtcacctcgattgatgcaagctttgctttgggagaggcgcttgtatctggtacagtttcagcagacaactacaaggttcgtgaaggcgcgatcattcaaaaaacgatttccgagaaaaagacggcagtctattctttggaaagcggcggcactgaggcgcgcgaagtcgaagcgggctgccggaaagagcaaacattaacagatgaacagatcatccggcttgaaaaactgggaaggagaatcgaagcccatttcggttttccgcaggatattgaatggtgtctggctgatggcgaatttttctttgtccagagccggcctataacgacattgtttcctcttccgaaacagagcgatgacaagcttcgcgtctatatgtctgtcgggcatcagcaaatgatgacagaaccgatcaatccgcttggaatatcgtttttcgggttgatctcggattatgagctgacttgtgccggcggaaggctttttattgatttatcacacgatttggcatcttttgcagggcggaaagtcgtcctcagtacggcggggaaaaatgatcctttcatgcatagcgctcttgtgaattttttgaaaagaaaggagcttgtcaaaaccctgccgaaagggaagcggatgtttagattaggggctgaagggctgtcatggtcgctgccgggtgatgcgctgaagatttaccggaaaaacgacacagatgtagtcaaacggctcatgtcgaaagcggaagcatccattcaagaggctgaacagcgattgaaaaacgcatcgggtgaaacgttatttgcacagatagaagaggatcaaaaaagcttgaaaaaagttctctatgattcagagagcatggctgtaattatggttggtttatatgccgtttactggctcaatcgaaaaatggagaaatggcttggcgaaaaaaatgtcgccgataccctttctcaatcggtattgtacaatgtcacatctgaaatgggattggcgcttttggatgtatcagatgctgccagaggataccccgaggttcagaagtatttagcatatgccaataatgaaaccttttttgaagatctcaaacagcttgacggcggtcccgcctttatcggcgcattgcgggcattccttgagaagtacggcatgcgctgcaccggtgagatcgatataaccaagacccgctggagcgaacgtccttccattcttgctccaatcattttgagcaacatcaagaattttgagcccggcgcgcgaacggctaagtttgaacaggggcgattggaagcggagaaaaaggagagggatttgttaagccgtctgcaacaactaaagggaggcagacaaaaggcaaaaaggacaaagaagatgatcagcgtgctgcggaattttatcggctatcgggaatatcccaaatacgctctgatcaaacgctatttcatatataaggaagcgttgatgaaagaagccgctgttttacagcaaaagaagctgatacaagcgaaggaggatatttattatttgtcctttgatgaattgaaagaagccgtgtgcacaaaccgtctcgatgtgaagaagatcgaggaaagaaaagcggaatatcggcattatgaaaaattgacgcctccgcgaatcatgacttcagaaggcgaggtcatcaccggagaagccttgggggatcacattccggcaggagcgttggcgggcgttcctgtttcatcggggatcatcgaaggaagggcaagagtgattctgaaattggaggaagccgatatcgaagagggggatatccttgtcacgccttttacagatccgagctggacaccgttatttgtctcaatcaaaggtttggtgactgaagtgggcggcctcatgacacacggcgctgttattgcgcgggaatacgggcttccggcggtggtgggggttgagcatgcgacgaaagaaattaaagacggacagaagatcaggattaacggatcggaaggatatgttgaaatactcgaatgataaaaagcgcagctagaagcttgcgctttaatttttataaaggtcggcggacaacatccaatccatcaattgctgatacggataataggtcgtgccatttaattcaattttaggtatgtcaggatatttacgcagcatttctttcgtttctactttgctcaagcctaaataataatgtaaatcgtcttctttgattaaatagggatagcctgaataaattccctttgggtttttaaagtttttcaagccgtcaccgataaaatagcctaaagccgctaaaccaagtccgatccaaaacaggttcatctccacgtttaccatccttttctcatattgctttatctgtcatacgaaaaggattgaaaaaagtttcaaggtcaaaggctttgccggttcagcatctcataaagaacgacggcatggttatggcgctcatctttggccccgtaaagcagaataacggtttcgtccgccgccattttttttaattccctgaagcttttctgtttttcagcgttttgtttaatttcgttttgataggcttctttaaacgattcgaattttttcggatcatgaccgaaccattttcttaattcggggcttggagcgatttctttcatccagcagtcggggttcgctttttcttttgatatgccgcgcggccacacacgatcgattaaaatgcggcgtccttctgtttgctggttttcttgataaatgcgctggagaataaacggcatgcggatcactccttctcattttatgataaaacggcaggctggaaggaacaaccctattgaaaaagacaatgccaacattccgtttattcgatggaatgttttaaagaactgtacaattggctgacgctttcatcgatttcatctcttgacatccgcaaggctttttccgatacggcatagccgatttccaaccggccttcttccagccctttaaagatcgcatcggcaaattcatccaaaggagctccggaatcatgcagtccgacaccgcccagatccgtattgaccgcaggaggagcgacttctatgacctcaacgccggcctcggaaagctggtgtcttaaactcatcgtaaaggagtggagagcggcttttgtcgatgagtagattggtgcgaccgccatcggtgtaaacgccagccctgatgacacattgatgatcgcagttttcccggctttttcggcaaagtatcggctaaagagcatggccagatggataggcgcctccatattgacggtgatttctttattgtagtcagcccaattgtctataacatcggcttttaaaatgtggtagcgctgctgtatgcccgcattattcacaagtacgtttactcccggatgatgttctttgatccattcaaataatgccagtcgttccgtttcaacggccacatcgcatacacacgtgatcagctccggatgtttttcctttgcttctttaagcttgctttcccttctcccgcagacgataacggtatttcccgcttttataaatcgttcggcaaaagcaaagccgattcccgatgcgccgcctgtgatcagcactgtgtttcccgacagttccattggaatccctcttttccgtcaaattttaaacaataggttgagcatctcttctgaccctataatgcccctttattttccaaaatgcaagtattctgattagacggtatgttccgattccattatcattgaaaagtgaaaggggtggaataaaatgtatgatacaactgtcgaaacacgcttcggaaagctgaaaggcagagcggaaaacggagtccgtatctttaaaggcgttccatacgcaaaacctcccgtcggcgacctaaggtttcgggaaccgcagcgaatggaggcctgggaaggtgagctggatgcttttcaatttggcccggtttgtccgcagcctgatggggtattgcctgagtcagcgggggttcaaaagtctgaggattgcctttatttaaatgtgtacgcacccgaagaggcggacggggatctgcctgttatggtgtggattcatgggggcgctttttatcgcggcgccggaagtgaaccgctctatgacgggactcagcttgcaaagcagggaaaggtgatcgtggtcaccatcaattatcgcctcggtccgttcggttttttgcatctatcctcaattgatgattcctacagcagcaatcttggcctgctggatcaaatcgcggctctcgagtgggtgaaagacaatatcgctttctttggcggagaccgtcatcacattacggtttttggagagtcggcgggatcgatgagcatcgcttcgcttttggcgatgccgaaagcaaaggggctttttcaacaggccattatggaaagcggggcttccgcaactatgtccgataagcttgcgaaagctgcagcagaaagattcttaaggattctcgatattgatcatcatcatctggagcgccttcatgatgtatctgatcaagaacttcttgaagccgccgatcagctgcgcactttaatgggagaaaatatttttgaattgatttttctgcctgcgcttgacgaaaaaaccttgccgctgaagccggaggtcgccgtcgcaaaaggcgcggcaaaagagatcaatctattaatcggaacaaaccgtgatgaaggcgtcttgttttttccctctgattcggatcttttgcctgagagcaagatcaacgagattttagaagaatacatgggtaaagaggccgccgaagccgcctcctctctgtatccgaggtcattggaaggccatgttgatatgatgacagatctgatcttttggcatccgtctgttgtgttcgcttcggctcaatcacgatatgcatctgtctttatgtaccggtttgactggcatgcggattcagagcagccgccgttcaacaaagctgcgcacggcttagagattccgtttgtatttggaaatatggacattttggaacagctgacaggtacgaaggccggtgaagaagcgcagctgcttgctgaacagatccaggctgcctgggtgtcttttgcccgatccggaaatccgagcaccgatgatgtcagctggcctgattatgatgaagattcacggaaaacgctgatttttgatcaagaggtcgcagttgaaagcgatccttattcagataagagaaagatgttgacagccccgaacccgcagatttagaacaagcgggcctgacctgtgtggtcagccgctttgatgatagcgttcgctttgaatggcttcaagcgatttgccgcgcgtttccggcgccatacggagcccgatgatcatatgaatgacgagaaatgcaatcatgacggcgccggctgttttgaagcccaagcccgtaatcatcgccggaacgaccaatgagatgagtccgacgccgatgcggacggtgaagaacatgaagccttgagcgagcgccctgtatttcgtatgaaacagctctgccgcccacagtccgtaaaacgcctgcgctccaaaacccgcagaaatgccccacaggcatacgaataataaaagctccgtgatgttcatcgtgccgaaggtgaggatgacccatgcggcggttgccatagctgctcctatgccaaaaagcaacttccgattgactttatcgccgagacggataaagacgaagtatgtggacgccacagtcaaaatccataaaaatgcctgcagcaggttggcttgtgccgctgttaggccgccgaccgtctcatagatatacggcatgaaatatcccatcgtcccggcaacaaggttccaaaacgcataaattccgatgaggagaatcatcgcgcgaaggttcgctttgttggtcaacagctctttgatcgacgccttttcttcaactccttttgctttgtcttcggcttcttttcgcttttgctcctcccagatggacgattcgtgaatctgctgctgcaaaatccaggtgatgactgcgacgacgaataattgggcaaaaatcaaccggcttcccattaaaccgagcggcgccaaggcaactgataacagcagcgtaagcgccggtccgaccgaccatgccagctgcccccagccgacgcgtccggcccgttcatggtcaggggcctcctcggcaatgtaagtccaagcagccggaattgctgcgcccaccgcaattcccgtcacgatgtatccggttaaaagcatgggaaaattaaacgacgcggcgatcagtaaaacgccaagcatatagactaatagatcgtatttatatatgaattttctcccgtaacggtcgactaaaaaaccgccgagaaaagcgccgatcgccgcgccgaaaccatttgcgcttaaggcgccgagaagtccgacccgggcgtcgtccaatcctaaatattcaacccataacgaaagcccgccggcccccgcgacgatggatcccgcctccaaatagttggacatggcgaccgtaatcgtcgacttcaaactgcctttttttctccctggcatgattcgttcccctttcaaatcagaattcttttctgacagaagccggattgatgcgttgaatgctcgattttaccctagcgagtcatgcaaaattgtaagcgttatcatctcgtggtaatcccgaccctgcatccgttccagccttcaggctgttccgaatgttttgcttatagtattactttattcggaaaacaaaaataaatcaacataaaaatcagaatattccgtctgaatatttttgtttttgtttggatttttttctcgaaaaactgccattatatcaattttttattaaaaaacctaaacttttcctctggaaaatagtatatttaaactaagtatattttactataaggaggaatttcttagatgagtatattaagcaggttcaaagacattatggccagcaatattaacgctttgctggataaagcggagaacacggaaaaaatggtggatcagtatgtcaggaacttaaacagcgacttaaacaaagtaaaggcggaaacggcgtccgtcatggcggccgagcaaagggcaaaaagagaactggcggattgccgggcggaaatcgacaagcttgagcgctatgcaatgaaggctttggaagccggcagcgaggcggatgcccgaacatttttagaaaagaaagcggtgcttgaaacgaaggcatccgagttagaaactgcgtttcaaacggcgtcatccaatgcgaatcaaatgaaaaaaatgcacgataagctcgtttccgatatcggggagcttgaagcacgccgcgccgcgatcaaagcgaaatggacagcggcgaaaacacaggaaagaatgaataaactcggtgcatctgcagcgaatgccaaccattcaatgtccgctttcggcagaatggaagaaaaggcaaaccgggcgcttgatgaagcgaatgcgatggctgaattgaacgccgctcctcaagatgacatagaagacctgaaggctaaatatgacagcccttctaatgtggatgatgcgcttgccgcattgaaagcgaaaatggcgggtcaaaagtcatagcatttgaaatgaataaagtgagaggttaagagacatggtaatttcttataaatgtccgggctgcggggatgacatggcctttgacgctgaatcgggcacgctcgcctgccgcagctgcgggagacaggacaagattgaaaacattccggaagaattgaaaactgcgagatttactgaagatgaagcaacagaatatcattgccaaaactgcggcgctattttgatcactgagaaagaaacgacggctacatcctgcagcttttgcggaggagcggcagtgatcgccgaccgcctgtccggaagccttgctccggcaaaggtcattccttttacgatcagcaaagaggaggcggcggacgcgtttcgcaagtggtgcagaaaagggctgctcacaccaaagggctttatgtcggctgaccggattaaaagcattacaggcatgtacgtccctttctggatgtacgatttaaacagcaaagtgcaggtcagcgcccgctgcacaaaggtacataggtatatacagggcgactatatctacacggagaccgaacattatgatgcgtttcgcgatatcaatctcgactacatcaaagtcccggtggatgcctcagaaaagatgaacgatcaattgatggacaaattggagccatatccatatgatcagctgaaagattttaaaacggcctatttggcaggctacatcgctgaaaaatataattacgatgatgaagagctttttccgcgggcgaaaagcaaaatcagcggctacatcgagtcatatatcgattccaccctgtccgggtacagctcagtcgatgtgaaaacgaaacacgtcgatacacaaaaagtgaaaagcttgtatgtgcttttgcccgtctggatggtcaattacaactacaaacaaaaggattacatctttgccatgaacggacaaacgggaaaagtcgtcggcaagccgccgatcagctcatttaaagaaaaaatgtggttcagcgggctggccgtctccatatttgcactctggaaaatcattgctgctgtaatgggaggcggggcgtgatgagaagtttattgagaagcgcgatgatcttatgtatgattttccttgtcttcatccctatagcctccggtgcggcagcctctgaacagaagcggtttgtttatgatgaagccgggcttctgaccaaacaggaaatcgagaagctggaaacgctggcagccaaattgggcgccgaacgggagaccgactttatcattgtgacgaccaatgatacaaacggccgcgatgtaaagaaatatgcggaggacttctatgacgaaaaagcgcccggctaccagaagaagcacggaaatgcagccgtattaacggtagatatggagcatagagaagtctatcttgccggctttaaaaaggctgaagaatatttgaatgacgccaggctggacaaaattagagaaaaaatcacgccggatatatccgacaagcattatgaggccgcattcgaaatgtttatgaaggcggcgcatgatgatatggagaagaaaccgtgggcggacagcatcttttttaagacgtggtttcaattgcttgtttcggcagtcatcgcgggaattgccgtcgccattatgaaatacaattcaggcggcaaagtgacagtaagtgcaagcacttatatgaacggtgatacgtccggagtgatcagaaataatgacgaatacatcagaacgaccgtcacaaaacagagaaaaccgtccaataataaaagctcaggcggcggaacgacgagcggaggccattcgcacagcggcagccggggaagcttttagaaagggaaaggaagagcttaaatggtgttttttagaaatcaatttgcaaatgtagtagagtgggatgaatttcgcgatgatatgattttctataaatggaacaaccgcgaaatcaaaaaggggagccggctgatcattcgccccggtcaggatgccgtctttttaaacaacggaaaaattgaaggcattttccaggatgagggcgactatgatattgaatccgaaattattccttttttatccactttaaaaggttttaaatttggctttaacagcgggatgcgcgccgaagtcctgtttgtcaacacgaaggaatttaccgtcaagtgggggacgaagaatgccatcaatatcccggctgcaggacttccgggcggcatgccgatcagggcgaacggaacatttaactttaaggtgaatgattatgtcgcattaatcgataaaattgccggtgtgaaagatcagtatgttgtggaagatatcaaaatacggatcacatccattctcgatcagcttctgatgaagtggatcacaaaagaaggaaaagatatgttcaaccttcaagccaacgcctttgatatcgcaaagggaatcaaggaagatcttgatatggagattgtcggcgacggcatgacgataacaggctttaacatcatgagtttcaattatccgaaagaagtccaggacatgatcacgaaaaacgcttcccacggcatggtcggcgatctgaacagatatcagcagatttcaatgacagacggcatggcttcaggaaagatgacaggcggcggtgccgcatctgacatggccggcatgatgatggggatgaacgtggcgaaccaaatgatgaatcagatgaaccaaaatcagcaggcgcaaacacagacgccaccaagcgcgccgcagccagcggcaaaaccgaacttctgtccaaactgcggaacgaaaacgggcgaagccaatttctgtccgaactgcggtcagaagctagtgtaagcggggggatcggttgatgccggcaaagttggtatcttctatgtgaatgagggctttcgctgccggcacgatcgccggcataccaagccggaaactgatggaacagaagctgatcctgatacacaagtcggattaattgcgtgatcagagcgcccgccgtattctatatataacaatgatgtcggatgaaaagaatgcggcatacatcaatcaaggatgtacagaataatcaaaggaaacaatctggaggaaaagcgacatggaattaggcatcagcacttttgtagaaacgacccctgatatcaaaaccggaaaagtcatcagccatgcggagcggctgcgcgaagtagtggaggagatcgtccttgccgatcaggtgggcttggatgtattcggagttggagagcatcatcgtcaagattacgcagcttcttctcctgccgtcgtcctggccgcagcagcttcacagacgaagcgcatcagattaacgagcgcggtcaccgtgctgtcgtcggctgatcccgtccgtgtttttcaggattttgcgacgctcgacgggatttcaaacggcagggcggaaatcatggcgggcagggggtctttcatcgaatcctttccgctgtttggatatgatttagacgattatgatgagctctttgaagaaaagcttgatttgctgctcgaactgcaaaagtcggaaagggtcacatggagcggcaagcatcgcccggctattcacaatacaggcgtttacccgcgtcccgtgcagaagccgctgcctgtatggatcggaagcggcggaaaccaggaatccgtcgttcgcgccggcctgctcggcctgccgctggttctcgcgatcatcggcgggagtccgcagcactttgccccgcttgttgagctttattacaaagcagcggaacatgcagggcatgacgcctcaaagctgattgtcgcttcccattcccacggctttatcgcggaggataccgagacggccgccgatcgttttttcccttccacccagcaggccatgaatacgctcgcaagagagcggggctgggggccgtacagccggtcgagcttcgatgcagccagaagctttgaaggggcgctctatgtaggcgatcctgagacggtggcggaaaaaattattcatctgcgcaagaatgtcgggatcacccgatttttgcttcacgttccggtcggttcgatgccgcacgaagatgtcatgaaggcgattgaactttttggaacaaaaacggcgccgctcgtcagggaagaagtatcccgctgggaggcatccgaaaggtcataacatgaaaggcccgcgctttagcgcaggcctttttatttcatataatgctttttaaaatccggatgtatcgaaaatttgcggcgcaaatggatcaggttttcgccgaaactttcctccaatacctctctgtgcttctccatgatttccatcaggtacaaatcatgaatcatcacttcggtaatcggcatcaccaagcctacatgcatcgtccaggctgcgcggctgtctttcccatgcgagacaatgccggccacaacttctgaatcgtcgacgctgaatacgagccagcgtccgtcatactcttctgtaatttgcctgctgttgtcatgtagatagacattggcgaaatccgcttcaatgtcgccgtatgcaataatggtcacaatgacgcctttttttgcggcccgcttgagctcaggctccaattcaggaaaatcctctttccaaatttccaggagaatcctttttccggccgatgatatgcacgcctttactttatcgagaatctcgcttcgcccggtgatgttccaaatattttcccggtcatttgcagtgcgctcaaacttctcgaaatatttttctgcctgttcaaaagtctcttccgctttcatccgccggtttttaatcaggtccttggcgggaacgggaatgtactgcggtgtgttgccgtagctgacaaatatatcgccgcggattacaaggctctccagcacttcgtatattttcgaccggggaacacccgatttttttgccaccgcatagcctgtcagcggcgattcttccaagagcgccaagtatgctttcgattcatactcggtgaaattcaggtttttcagtacgtctaatatgttttccttcataagccctccagcttcaacaagagtcgctacctttgtcactcatattttgctggatgtattgatttatttcaagtccgctgatacactttttataagtggttacttgagtagtcactatataaaaacagtattggggggagacatctgatggatagcctgctgtcatacatatcgattgcagccatgatggtggtgatacccggagccgatacgatgcttgtggtgaaaaacacgcttcgatacggtccgaacgccgggcgctgcaatgttctcggcttggcgacggggctttctttctggacgctgattgccgttctcggcttagcggtggtgattgcgaaatcggtgattctgttcaatacgatcaaatacttgggggcggcctatttaatatatttaggcattaaaagctttttcgcgaaaaaaatgttttctttggaagagatacaagccgagaagaacaaaaacgaaaacgcatcaagccggcattataaggattcttttatgcaaggattgttcagcaacattctgaatccgaaaactgttttggtctatatcacgattatgcctcaatttattaacttaagagaaagcgtcaaccagcagttgatcatcctcgctttaatccttacttttcttgctgtgttttggttcctcatcctcgtatatttgatcgatttcgcaaagaaatggctgagaagcgtgaaattccagaagatctttcaaaaagctgcgggtctggtgcttgtcggatttggcgttaaaacgggtttagattgatattggagaacgagtgagcgctttggctcactttttttgtttatttgtcaacgattatttgatagaaaacactagatgaaataagagtgctatggttattcgttgacattttgacaacgattctatatatttataccgacttggtctttgggctgatagattgatacatttttagcgtgggaggagaaaagctcgtggatgaacaaaagaaaaatcagctgggagtgctgctgaaagagcagttgcgaaaacgatcattatctttaagagaattgagcgaacgcactcaaatcgataaagcgaccatctcaagaatcatcaatggcaaaagaaaagcaaacctgaaccatttgcaaaggttttcagaaagcctcggcgtttcttttgatgagctgatgacagcggccggctatgcgatggagaagacgcaggaaagcgaacgtccggatattcactcgtcagttgccgaaattgaagatgttttgcaaacctcaaatgtctatgatcggccatttaccatggaagaactgaaaaacaaattgaatgagtgcgaacaatattctcagacggaggaaggaaagcgtaccattctggctgagtttgaatctaaaatcgagaaagttgccggcattggtccttttctgacccgtctgcacgacatgtacagcagatttacctcggggcgggggacgccgcgtgaattgctgctgatgggcggcgctttgctgtatttcatcgtttctgttgatgtcataccggattatatttttccgatcggctatatcgatgatgcggcagcggttcatttcgttttcaaccagctgtcatataaatcatgatggagcatgttcaagatgaaaagaaagcatatcaacattgacatcagtctgctgctcattctattttgtttgtttatcatcagcctgctggccgtttacagcgggtcgggccagtatgaaacacaggaccctttttattttgccaaacggcaggtcttttggtatcttgtcgggtttggcgtcatggcgggaacggcctacatcgactatgagctgcttgaacgattggcgcttcgtttatttgtgggagccgtttttcttctgattctcgttcatttttttggaacttacaaaaacggttcgcaaaggtggatcagcttcggggtcatcgaaatccagccttcagaatttatgaagatcattttgattcttctgctggcttcgatactcaatcaatttcagcataaaaggttctccttcgccgagagcatcattccgacgggaaaaatcatgatgtacacggtgattccgtttttctttatattggttcagccagatttagggtccgcattggtgattttatcgatcgcattcacgttgatgctggtctcggggatttcgggcaggatgatcgtgtccctgtcacttggattcatggcattggttgcctttttgacgtatttgcacaatcattactttgagatattttcaaagattattaagcctcaccagcttgaccggatatatggctggctcagtcctcatgaacatgcctctacatatggataccagctgacgcaggcgttattggggatcggatcaggccagctgtcagggagcggctttactcaaggaatccaagttcagggagggaaaattccggaggctcatactgattttattttcgccgtgattggtgaggaattcggttttttgggtgccgtaacattagtctgtctgtattttctgatgatctacagaatcatcaggattgcgctttcgtccaacagtctgttcggtctttatatatgtgcgggggttgcagggttgattgtattccaagtgttccaaaatatcgggatgacgatcgggttaatgccgatcacggggctcgctcttccgtttatcagctatggcggcagcgcgctgttgaccaacatgatcgctttaggtctcgttttcagtgtgaatatcagatctaaacattacatgtttgggaatgattggggatgaagttgctcaaaatgattctttcccatctaaagaaacttgattatgtattgattgccgcggttctgtttttatctgcgtttggcttgctgatggtatacagcgccggctaccccctcggatatatgaagtatcatgatggcagctatttttttatgaagcagctgcaatggctgctcatcggtttggcctttttttcggctgccgccattttcccatacaaagcttacagcaaactcattcggtttttggtgaagctttcttttttaatgctgattctcgttttgctgccgggaatcgggatggagaaaaacaattcccaaaggtggattcaattcggttcgctcatgattcagccgtctgaggctgtgaagcttgtgatggttatttatttcgcctatgtgtatgcaaaaaagcagaaatacatcgccgatttcggaaagggcgtcatgccgccgctgctgattttggcggctgtgttttttttgattttaaaacagcctgacttgggcaccgccgtttccatcctgttaagctgcggagcggttctgttgtgcgccggcctcagaatgcggcacttgctgcttctcggaacaatggcaggggctggcatcgcatattttgcaataacagcgccgtaccggttaaaaaggctgacatcgttcagcgatccttttcaaaatgaaaacggagacggctaccagttgatcaattcctaccttgccattgattcgggcgggttatgggggaatggattggggaacagcgttcaaaagctgggatttcttcccgaagcccatacggactttatcatggcggtcatcactgaagaactcggcggtatcgggctggcggtgatcatctgggcttacctgttgatcatgttcagaggggttcggatcgctgtgcaaatcgatgatccgtttggaaagctgctggcggtcggccttactttccagatcatgattcaagcgttatttaacctgggcgctgttttcggccttcttcccattaccggaattcctcttccgtttgtcagctacggaggttcttcgttattgttcatgctgacgacagccgggatattggtcaacctctcatcacatgttaagcggggagttaaaaaagatgtggcctttcttttgtagagagtcttttcttaactttgaagtggagaattttatctcaaagttacgattgttgatcttgtcttctcatatagaatttgaccgggacgtgtttatacatataaatgcgttcatattgataaataaaggaaatcatgatatattcaaggtgtatgaaacagaataatctctttatatgaatgcataaactaaaaaagaccggaagatgcggcaacatctcccggaagcaacagagaggctccataaaaaggagtcggctctatttttagatcccaattaaaaagtaagatcgtcttggtgtgggaatcaagggcgatcttacttttttttgtcgtttgatgacagaatggccactacgagaatgccgaaagacaccatgagttgcaaggcctctgatactgtcacatgctcaccccctttctcttcaagagatggaggatgagccgaccgcccttatatagaaccgaactgctgccaacccttattataccaaaaagcagagttgtttccataaatgtccgttgacatgcaaatttgaaaaaccgcagttttcttaaaacgttctgcggtcaaactgagtaaatgctgttttttcttagccggaaccctgctcattcctttagcagctgatctagtgcaaaacaggccggttcattaaaacccggcctgtttgaaatatattgttcatttatgcgggacgcgcggcaaaaatttggaaggcaacgccgaacggatcagtgacaatgccgtatgcgggactgaaataagtttccttcagctcaagcttgacctcgccccgctcgctcagcttgccgaaaagccgcttggccgaagaaacatcggctgccgttacgcaaatggacaattggtttccgctttggaaaggcagttcaggaataatgtcggcgatcatcaggacagcgtcgccgattgtcaaaacggcatgtgcgatgaaatccaattcgtcttccttaaagttcgctgcctcatctgcggggccttcaccaatcgtctgactgaactttacttcggcatcgagtacatcacggtaataatcaatcgcttcctttgctcttccattcatcaggatataaggtgtgaatcgcgttttcatagggggaacatctcctttttttgttgatctaaggagattgtatattataatggtgacaactaatgtcgtggttaaaaaataattggaggtattcatgtctaaagcgaaacgattgaatgaaatgatcatgatggtaaaccggaaaaaacgatttacggtcggggagctggcgcgggaattcggggtttcaaagagaacggttttaagggatttgcaagagctcagcgaaatgggggtgcccctctattctgaaaccggcccccacggaggatatcaggtgttaaatgaaaggattcttcctcccatcgccttcagcgagaacgaagcgatctcaatcttctttgcgatcgatgcactgaagcattatatatccctgccgtttgatgcccagtacgcatccatcaaaaagaaattttatttaaacctttcaggagatatccgggatgcgattgacagtatgaaggaccgcgttgctttttatacgccttatgagcaaacagacgacattccggttttaaaggtgctgcttgaggcagcggttcagcaaaaggtgttgatcatcgagtatgaagcaaatggcgcatcaagcaagaggagcattcagccgatcggaatctatgccaatcaagggaagtggtattgcccggcttactgttttttaagaaaggattaccgcatattcaggtgcgaccggatcaagcgggccgagcttgatgaacataaggcaccgattgatttgtccggcctcaatttaaagaaccgtttttcggctttgtcccggccaagggagacattggaattatccgccgagctgacaaaaaagggagtagagcggcacggttcactcaaatggccgcaccttgaactgcatgtaagagaagatgggtccggcgtgctgaaaggcgaaatcgcgccgaaggatatcgatttttttgcggattatttcatttcgttcggccgggaagcggttattcagaagccttccaaattaattgaaaggatgaaacggacattatccgacatgctgaaacaatacggctgaaatgaagactccggtataccgcagcctgcgtttttctgcatttaaagttccgcaaaaaacgcgtgaagacgcatgtcttcttcatcctccagttaaagacactctcaggaatcgagagtgtcttatttttgccgtcagaagaaatttttacccaaaaaagttgacggcagatttaaaagtgagtatcattacaaatatgatattaatattacatttttgttacaaaagaaaatgatatgttacgagtttaaaagaagattgacaaaggagcatgcttatgaaaaaagcgatggcttttttaggattccttgtactcacagcatcgctgctatttatcatcaataaaggaacatctcaaataaacgcttcacaaaatagaaaagccgcggttcacacggagtattacaaagacatcagttcgctttcttttccggtattcagcgatttgaaggaagaggatgccaagctggcgaacgatgcggtaaaacttcatttaaaaaattcctataaagaatttcaaaaaatcgttaatgatgccgaaaagaaggataaggatgaagaaaacgtttatgaaacgtcctacaaagtcaaatacaacgaggaaggcaaactgagctttttaatctatgactatcagttctccggcggtgcgcacggcatgtacaccgtaacatcctacaactttgactttgacaagcataaacaagtcgtgctgactgacgtattaaacaatcaggcgaaaatcgaaaaggcaaaaaactatattttcagctatatcaacgaacatccggaacagttttattctgatcttaaaaagagcgatatccgtttggatgaacatacggcattctattatacaagcagcggaatttcaattgtatttcagcagtatgatatcgccccgtatgcagccggaaaccaggaaataaagcttccgtcgacgcttttatattagccccggcattagatctaatatttgtaatagaaacagagagagcaagtcgtgaaacaggagagtgagcagcgatgtctggcaaaccatcatttcgatgggttaaaatgttgatttttttaacgatattaataggtttggcagggtactcttacaataaagtgtcaagcaacagccaagagccccctcagccaaaaaaagaccgcggacaatccggcctcggcgtcgaatccatggtcaatgacagcaaacaagagaggtatgccatccattatccggtgtttcacataaaagaaatcgatgaacaaataaaagattatgtgaatcaagaattggccggttttaaagaggataacgcaaaggcccaggctcaggatgaagacgggccttttgaactgaacattaaatataaggttgtctattatacaaaggatacggccagtgttgtgctgaatcaatacatagaggccggcggcgtatcgggtacaacatctgtcaagacgtttaacgctgatttaaagcagaaaaagctgctgtcccttcaagatctgtttgaagagaattcagattttctgaacaggatttcaagcattgcctatcaggaattgaaaaatcggaatccgtctgctgacatggctttattaaaagaagggacgagccctcaggaagaacatttcagccgctttgcgcttcttgaaaacgaggtggaattttattttgagaaaaaacaaaccggtcttgaacagtctgtaaaaataaaaaaagaatgggtaaaagatattttaaaagaccgatatcaggatatgaaaaagaatcgtcttcaggccaaacctgatcaggagcctgttccgcttccgaagcaagcgaaaattaatcccgatgaaaaagtgattgccctcacatttgatgacggtccgaatcccgctacaacgaataaaatattaaacgctttacagaagcatgaagggcatgcgaccttctttgtgcttggaagcagagcgcaatattatcccgaaacgataaaacggatgctgaaggaaggaaacgaagtcggcaaccattcctgggaccatccgttattgacaaggctgtcaaacgaaaaagcgtatcaggagattaacgacacgcaagaaatgatcgaaaaaatcagcggacacctgcctgtacacttgcgtcctccatacggcgggatcaatgattccgtccgctcgctttccaatctgaaggtttcattgtgggatgttgatccggaagattggaagtacaaaaataagcaaaagattgtcaatcatgtcatgagccatgcgggagacggaaaaatcgtcttaatgcacgatatttatgcaacgtccgcagatgctgctgaagagattattaaaaagctgaaagcaaaaggctatcaattggtaactgtatctcagcttgaagaagtgaagaagcagagaggctattgaataaatgagtagaaagcgccatatcggcgcttttcttttggaagaaaatatagggaaaatggtatttgttaaaaattcggaatatttatacaatatcatatgtttcacattgaaaggggaggagaatcatgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaagcggttacatttgtcgataaccatgatacacagccggggcaatcgcttgagtcgactgtccaaacatggtttaagccgcttgcttacgctttcattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatagaagagcagagaggacggatttcctgaaggaaatccgtttttttattttgcccgtcttataaatttctttgattacattttataattaattttaacaaagtgtcatcagccctcaggaaggacttgctgacagtttgaatcgcataggtaaggcggggatgaaatggcaacgttatctgatgtagcaaagaaagcaaatgtgtcgaaaatgacggtatcgcgggtgatcaatcatcctgagactgtgacggatgaattgaaaaagcttgttcattccgcaatgaaggagctcaattatataccgaactatgcagcaagagcgctcgttcaaaacagaacacaggtcgtcaagctgctcatactggaagaaatggatacaacagaaccttattatatgaatctgttaacgggaatcagccgcgagctggaccgtcatcattatgctttgcagcttgtcacaaggaaatctctcaatatcggccagtgcgacggcattattgcgacggggttgagaaaagccgattttgaagggctcatcaaggtttttgaaaagcctgtcgttgtattcgggcaaaatgaaatgggctacgattttattgatgttaacaatgaaaaaggaacctatatggcaacacgtcacgtcattggtctgggcgtccgcaatgtcgtcttttttgggatcgatttggatgagccctttgaacggtcaagggaaaaaggctaccttcaggcgatggaaggcagtctgaaaaaagcagcgattttccggatggaaaacagttcaaaaaaaagtgaagcacgcgcgcgggaagtgcttgcatcctttgacgcacctgcagcggttgtttgcgcttcggaccgaatcgcgctcggggttatccgcgcggtgcaatcgcttggtaaaagaattccggaagatgtcgcggtcaccggctatgacggggtgtttctcgaccggatcgcttcgcctcgcctgacaaccgtcagacagcctgttgttgaaatgggagaggcttgcgcgagaatcctgctgaaaaaaatcaatgaagacggagcgccgcaaggcaatcaattttttgagccggagcttattgtccgcgaatcgactttgtagggtgtctcattctgttaccgttaacagctgaaaatgattgttcctgttaccgccgtcatgataatttcagaataaaagccggtttatcacagccggacaaccaaaagggggaaacatgatggaatatgcagcgatacatcatcagcctttcagctctgatgcctattcttacaatggacggacattgcacatcaagatccgtacaaaaaaggatgatgccgaacacgtccgcttggtttggggcgatccttacgaatacaccggcggcacatggaaagcgaacgagcttgcgatggcgaaaattgccgcaacaagcacccatgattactggtttgccgaagtggcgcctccattcaggcgtctgcaatacggatttatcctgacaggcgctgatgatcgagacactttttacggaagcaatggtgcatgtccgtttgccgggaaagcggcggatataggcaaacactgttttaaatttccgtttgttcatgaggcagacacgtttgatgcacctgactgggtcaaatcaaccgtctggtatcaaatttttccggagcgctttgccagcgggcgggaagatttgtctccggaaaacgctttgccatggggaagcaaagatcctgaggcgcacgattttttcggaggggatttgcaggggatcatggacaagctggactatttggaagacttgggggtaggcggaatctatttgacgccgatctttgccgcgccttccaaccataaatacgacacattggactattgctccatcgatccgcattttggcgatgaggagctctttcgcacgctggtcagccggattcacgagcggggaatgaaaatcatgcttgatgctgtttttaaccacattggcagcgcttcgcaagagtggcaggatgttgtcaaaaacggtgaaacgtcccgctataaagactggttccatattcattctttccctgttaaagaaggcagctatgatacatttgcgtttactcccgagatgccgaagctcaatacggccaacccggaagttcaggcttatttgcttgatattgcgctgtactggatccgcgaatttgatatcgacggctggcgtttggatgtggcaaatgaagttgatcatgcgttttggaagaaattccggcaagccgtcacggcagaaaagcccgacatttttatattgggcgaaatctggcatcaggctgatccgtggcttagaggagacgaatttcattcggtcatgaactacccgttcacagaaccgatgattgactattttgcagacggatcgatttcagcttcgcaaatggccagccgcatcaattcgcatttaatgagcgggatgaagcaggtcaatgaggtgatgtttaatttgctggacagtcatgacacgaagcggattttgacaagatgcggaggagatgacaaaaaggtgcgctctcttttggcattcatgtttgctcagacaggctcgccgtgcatttattacggaacggaagtcgggcttgacggcggcgatgatccattgtgccggaagtgcatggtttgggaagaggaaaaacagaatcaagagatgctcgcatttatgaaacggctgatcgctttgcgaaaacaagagaatgatgtattgacttatggcgcgcttgagtggaagctggttgatgaccaaaacgattttgtcagtttttctcgaacgcatgaaggaaaagagctgatctacttcttccaccagggcagcgaggtgcgccgtgtcagattgcgggatttgaagattgcaagcgataaaagaatatacgatgcgtggacggaagaagcgcttcagcatgatgatgtggtcgacattcagccaggcggatttttcattttgggggcggtctaaattctgttaccggtaacaggtttaaaactattgtaaccgctttctgtcgaggattacaattgtctcagattccaagatagaagggggaaaaaagatgcaacatttaaaaaaaggaattttagtgctgctggcgtcagttctgctgttcggtcttgccgcctgttcaagttcaaaggaaacgggaggcagcggcgggaaaaaagtgctgaccgtgtctgtagaagaggtctataaaccttacgtcgaaagcataaaggaaggttttgaaaaagagaatgatgtgacagtcaaaatcgttgaaaagccgatgttcgaccagcttgaagcgcttccgcttgacggtccggcaggcaatgcgcccgatgtcatgcttgcggcatacgaccgtatcggcggcttaggacagcaaggtcatttgctggaagtcaaaccgtctgacacaaaaagctttggagacaaagaaatgcagcaggtgacggttggcggaaaagtctatggaatcccgcttgttattgaaactctcgtactctattacaacaaagacctgttaaaaacgccgccaaaaacttttaacgagctcgaggatttaacaaaagacaagaggttcgctttttcttcggaaaaaggaaaatcgaccgcctttcttgcaaaatggacggacttttacatgtcatacggtttaatggccggatacggcgatatgtattcggagctgacggcacggattccggagacatcggtctgaacaacaagggagccgtagaggcggtggaatacgccgaaaaatggtttagtgaatattggccgaaaggcatgcaggacaatacgagcgcagacgattttatccagcagacctttatggacggaatagcagcggctgttatcggaggtccttggtcggcttccaattataaagaagccggtttgaactacggcgcagcgaaaatcccgacattgccgaacggagaagagtatgccccgtttgcaggcggaaaaggctgggtcgcctcaaaatatacgaaagagccggagcttgctgagaaatggcttcaatatgccgcaaatgacgaaaacgcttaccgcttttatgaagatacgaacgaagttccggccaacctcgctgctcgaaagaaagcaggggagcaaaaaagcgagctgacgtcggcggtcatcacacaatacgaaacggcgactccaactccgaatattccggaaatggccgaagtgtggacaggtgcagaaagcttgatatttgacgcggcagcagggaaaaaatcggctcagcaatcagcggatgatgccgtgcgcgtgatcaaagaaaacattaaagaaaagtatgtgaaataaaacggcggttttagcgtccggaagaatagagggcgaaaaaaatgaacaaagaccaaacactagcaaaccggagccggaaggcagcgctgttatcgataattcccggtgctggccagattgcaaaccggcagttttcaaaggggatcctttttctagtcatcacaggcttgtttatttgtgagttagcgattttcggttatcaggcgctgatcggtctcgtgacgctggggactgtccccggagaagaccactcgctgtttctcttgatagagggcacgctgcaattgattttgacgctcgttttcttgatgttttacatctttaatctgtatgatgcccggaagaccgccgcgatgaaggcggcgggtttgaaaatcagcgagacggctggggacatgatcagaaatgcaggtgacaaagggtttccgtatttatttacgctgccggcatatctcatgatggtgtttgtgattatttttccggtgctggtgactctgtttatcgcgtttacaaactacgatttttatcatattccgccaaacagtctcatcgactgggtcggctttaaaaatttcatgaatatctttttccttggctcgtatcggcaaacattcgccgatgtgctgggctggacgatcatctggacgatctgtgcgacgacgctgcaaattgttctcggcatcgtgacggcgctgatcgtcaatcagaactttattaaaggcaagcggatgttccggatcatcttcctgcttccgtgggccgttccggcatttattacgattatgagcttcgccaacattttcaacgactcggcgggcgcgatgaacgtccaggtgatcccgcttttgaaccagcttccgttcgtcgacatcccggctgtcgcatggaagaccgatccgttctggacgaagacggctttgattatgatccagacgtggctcggttttccctacatttatgtcatggtgacgggggtgcttcaggcgattcccggagagctttatgaagcggcaaagattgacggcgcgacatttattcagcgctttaaacacattacgctgccgatgattttatttgcgaccgcaccggtgatgattacccagtatacatttaatttcaataacttctcgatcatctatttatttaatgaaggcggtccggggagtgcgggggccggagccgggtcaaccgacatcttaatatcctggatctataagctgacgacggggacgtcgccgcagtattccgtggcggctgctgtcacactgctcatttctttcattgtcatcggggtttccctgattgcttttaagaaatcgaatgcctttggcaatgaggaggtcatgtagatgagagggctttttaaaaatacgcggttcaccgggatgctgaacaaggttttgacctatatatttttggcgtttttaagcatcgtgattatttatccgcttttgatcacagcatcatccgcattccgggtcgggaatgtagcggcttttacactcgatttttcgggcgcatggacattggaccactttaagcggctgtttgaagagacgctttacctcaattggtacgggaatacacttgtgatcgctctgtctgtcatggtgttccaggtgacgattgtgacgcttgccggctatacgtacagccgctaccggtttgcgggccgaaaaaagagcctcattttctttttgatcattcaaatggtgccgacgatggcggcgctgaccgctttttacgtcctggccatgctgatcggagctttggaccaatattggtttttaactgcaatctatatcggcggcggaattccgatgaacacatggctgatgaagggctactttgatacagtgccgagagaaatcgatgaagcggcgcgaattgatggagcggggcacctgcggatctttgcttcggtcgttctcccgcttgtgaaaccgatgcttgcagtccaggcgctgtgggcgtttatggggccgttcggcgactatctgctggcgaaatttctgcttcggtcgccggaaagcctgaccatcgccgtcggtttgcagacattcatctccaatccgcagcagcaaaaagtcgcgctgtttgcagctggggcgattcttgcagctctgccgatttgcatcttgttcttctttctccaaaagaactttgtgtccggtttgacatccggcggaacgaagggataaatcgatgaacgacatgcgaaacgaaaagctgatcgtccgatttcttaaagcagcggcatcaccggcgggcgtcatgcgctgcaaacatgcattcagctggctcgaaatttcttttctgtttatgtttttgactgcttgtttaatggcgcctatgacccttgcgtttatgaaaatggaccgcttcaatgccgggtatctgatcccgaacgtcgctcaagaggctgacgcggcattcatcaaacaattaaaaggctaccaattgacaaacggaagattgaagggcgaagacgagctgtaccgtgtggagaaagggagaaccctgctggccgtcgatttgaaggatgaattaaaaacaagcggtgagaacgggcggataaaagcggaaggctatcaaaatgcgctcatctttcagtcagatcatctgatcatcagtgatcaaagcggagcggggttttccgttcgctatccggcaaaggctgggctgaatgatctggatgccggtcatttgggggattttatcggtgcaatgtggtttgcccaatataagccgcttatcatcatgctggcctgttcggcggttttcatcatctcgctttttttaacggccgttctggcgggaggcatctggatctccaaaaaatccaacatgaccgggataaggtcgtttaagcaagcggccgcagcggcggtgtgcggatcggcgcttccggcaggagccgcaatggctttcggtatgatcagctttgacttcatcgcgatgctgctcatccattcgtgcggtagtgctttgatggtctctttcattttcaggcacatcttcaagaaccgccatcacaacgaaaatctacagtcaggaggaaatcatggcaaatcagcggctatttgagatcgaccagtggaaaatcaaaacaaacaaatttgaaaaggaacataaacggcttcaggaaagtctgacatccttggcgaacggatatatgggaatcagggggaattttgaagaaagctattcaggcgaaagtctcaaaggcacatatatcgcaggggtttggttccctgacaaaacgcgtgtcggctggtggaaaaacggctatcccgaatatttcgggaaagtgatcaatgcgatgaatttcatcggaattgatgtatatgtagacgacgaaaaagtcgacctcagccaaaacgacatcgaatcgtttgaattggagcttaatatgaaagaaggcatcttgcggagaagcgctgtcgtccgtgtgaatcaaaaggctgtcaaaatttcgtccgagcgctttcttagcctcgatgtcccgcaactgtgcgcgatccattatgaagcggaatgcctgaacgatgaagcggtcatcacgcttgttccttatcttgatggaaatgtcgcaaatgaggatgccaatttcgaagagcggttttggcaggaagaagcgaaaggcgccgaatctcatcgcggccatcttgtgacgaaaacgattgagaatccgtttggaaccccgcgttttacggtggctgcttctatgtgcaatgtgacggaaggatatgtcagcgagcattttcaaacggatgcaatgtacgcggaaaaccgctactgttacgaagtgggaccgggaacaaaggcttctttaaagaaattgatcattgtcacaacgtcccgggattttgaagaagcagagcttttagtacagggcagggcgcttttggcggatgttcttcggcagggatatgaagaagcgaagcggaggcataccgaacattggatggaaaggtgggcaaaagcggacattgaaattaaaggggatgatgagcttcagcagggcatccggtacaacctctttcagctcttctcgacatactacggagccgattcacgcttaaacatcgggccgaaaggatttaccggcgagaaatacggaggagccgcctattgggatactgaggcgtacgccgttccgatgtatttggcgacggcagagccggaggtgacgaagaatctgcttttgtaccgctatcatcatttggaggcagcaaaacggaatgccgccaaactggggctgaaaggagccctttatccgatggtcaccttcacaggcgatgaatgccacaatgaatgggagatcaccttcgaagaaattcaccgcaacggcgcgatctgttatgcgatctacaattatgtcaattatacaggcgaccgggactacatgaaagaatacgggatagacgttctcgtcgaaatcagcagattttgggcggaccgcgtccacttctcaaaacgaaacaataaatacatgatccacggcgtcacagggccgaatgaatatgaaaacaatgtcaacaacaactggtatacgaacttgattgcgtcatggacgcttgagtacacgctcgaaaacctcgctatcctcccggaggaaaaacgccgccggcttgatgtacgggaagccgaaatcgagaaatggaaggatatcatcgagcgaatgtactatccatacagtgaggaattaaatgtttttattcagcatgatactttcctggataaagagcttcaggcagcggatgagcttgaaccgggtgaccgtccgctctatcagaactggtcatgggataaaattctccgctccagttttattaagcaggctgatgttctgcaaggcatttatttctttaatcaccgatttacaatggaagaaaaacgtcgcaactttgaattttatgaaccgatgacagttcatgaatcgagcctttcgccatctgtccatgcggtgctggcggctgagctcaaaatggaaaagaaagcgctcgaactgtataagcgtacagcgaggcttgatctggataattacaatcatgacaccgaggaagggcttcatatcacttcgatgaccggaagctggctcgccatcgtgcaaggatttgccggcatgcgcactcaggatgagaagctgtcttttgctccgtttctgccgaaggaatgggacggttattcgttcaacatcaattatcgagaccggctaatcaatgtgcaggtagaggaaaacagcgtcgttttcagtcttttaaaaggagaaccgctttctatgacagtttatggagaacagatcgcactgaacggacggtatgaaaggaggatggcccgatgagccaatggtggaaagaggcagtcgtgtatcaaatttacccgcggagtttttatgattccaacggagacggcttcggtgatttgcagggggtgattcaaaagctcgattacatcaaaagccttggagccgatgtcatatggctgtgtcctgtgtttgattccccgcaggatgacaacggctacgacatcagcgactatagaagcatatacgaaaagttcgggacgaacgatgatatgtttcaattgattgatgaagtgcataaacgcggaatgaaaatcattatggatcttgtcgtgaatcacacgtctgatgaacatgcctggtttgccgaaagccgcaagtcaaaggacaatccttaccgtgattattatttttggaaggatccaaaggcggacggttcagagccgaacaattggggatcgatcttttcagggccggcatggacgctcgatgagcggacaggacagtattatcttcactacttttcgaaaaagcagcctgacttaaactgggagaatgaagcggttcgccgcgaagtatacgatttgatgacattttggatggacagaggcgtggacggctggcggatggacgtgatcggttccatctccaaattcgtcgactttcccgattatgaaacagatgacagccgtccatatgtcgtcggccgctatcattcgaacggcccccgtctgcacgaatttatacaagagatgaaccgggaagtgctgtcccgttacgactgtatgacggtcggcgaagcaaacggctcagatgttgaagaagcgaaaaaatacacggatccaagcagacatgagctgaacatgatttttacatttgaacatatggatattgataccaaacagcattctccgaatgggaaatggcagatgaagccgtttgacccgatcgctttaaaaaagacgatgacgaggtggcagaccgctttaatgaatgtcggctggaatacgctttatttcgaaaatcatgatcagccgagggtcatatcccgctggggcaatgaccgcgagctccgcaaacaatgcgccaaagcatttgcaacagttctgcacggcatgaagggaaccccgttcatttatcaaggtgaagaaatcggcatgacaaacagcgagatgccgctcgaaatgtatgatgatctcgaaatcaaaaacgcataccgcgaacttgtcattgaaaacaaaacgatgacagaggaagactttcgaaaagccgtggcgaaaaaagggcgggatcatgcgagaacgccgatgcaatgggatgacgggaaatacgcgggctttacggatggagagccttggctggcggtaaatccccgctatcaagaaatcaatgtgaaagagtcgcttgccgatgaagattcgattttctattattatcagaagctcatcgggctgcgcaaacaaaataaagtcatcgtgtacggagactatcggctgctgctcgaggaagatccgcgaatctttgcgtatatccgcgaatatcggggcgaaaagctgttagtcgccgtgaatttatcagaagaaaaggcgctgtttcatgcttcgccggaattgcttgaggacagatgggatgtgctgttgtcaaactacgcccgagagcggcttaatataagcggcagtatcgacatggagccttatgaagctttcatgatgatcagccgggcaaaggattacacatcatgaaagcggtcatttttgacttggacggcgtgatcacggatacggccgagtatcattatctcgcatggaaacatactgcagaacaaatcggcattgagattgaccggagctttaatgaacggctgaaaggcatcaacagagagcagtcgcttgataagattttgattcacggcggcgcggccggaaagtttcaggaggcggagaaacaagagatcatgcgccggaaaaatcaatactaccaacagctgatccaaaacttgactccgcacgacctgctgccgggaatctccgtgctttttgccgaattgaaaagagaacatataagcattgcgttagcttcgtcaagccgaaacgcgcctgctattttgcagcggctcggtgtcatggacgaatttcagggtgtcgttgatccggccgcacttgctcacggaaagcccgaccccgaaatctttttgacggccgctgcactgctcggtgtgcctccgtctgaatgtgcagcaatcgaagatgctgaagccgggatcgccgcgatcaaatccgcagggatgttcgcggtgggagtcggtgatgagacatcgctgcgcggagccgatttgatcgtgcacaacacaaacgagctgacgtttgagctgctgaatgaaggatggcagcgctattgctgtataagagaaggaaaatgaaaagcaacccgagaatcataaaatgacaggccgccgctggcggccttatctgcaatcggagagggaagcaaaaccaagaacaagatcaagatcaaggcgttcggctggccggagagggagaccgttcagatatgcgttttgctggttatacaaccgatctcagcaacccgacttcgaatctatcaggcggttggatacagtcctgttgcagagtctatcgcctgcgtttttcaagaaaaacagcctaatcgatccctttaaaaggatgattaggctgtttgtttattggtgcatttgcaatttgacaaattttcgtttgccgacttggatgatcatgccgtgttcgagtgcaatgtccgcatgaatcgattccgctttggcgccgttgattttaacgccgccgttttggatcatgcggcgggcttcacttttggaaggaaggagttcgagcgtcaccaataaatcggtgaccggcaccgttccgccaccttgccagtgtacggctgttatattgtccggcgcgctgttttgctgaaaaactttcttaaactgctgttcggccgcttctgccgccttgcttccatgatacatgttgacaatggttttcccgagaagcatcttcgcgtctctcggatgaacggcccccgtttccaaatccttgacaagacgttttttttcttccgcctccaagtcggtcgcaagatggatatactttttcatcaaactgtccggcagagacatcgttttcccgaacatttcatgagggtcttcatcgatgccgatgtaattgttctttgatttagacattttttcaatgccgtcaagcccttcaagcagcggcatgagaatgacgacctgtttttcttttccgtacttttcctgaaagtgtctgcccatgagcacgttaaaatgctgatccgttccgcccagttcgatgtcgctgtccagaacgactgaatcatacccctgcatcaacgggtaaaagaactcatgaagcgaaatcggcttttgcatggcgattctttcttcaaaatcatcgcgttccattaaacgggcgacggtaattttgcccgcgagctcaatgacgtcttccaaggttaatcgtttaagccattttgagttgtagtgaagctcgaccttgttctgatcaagcacttttccaaactgttgaaagtatgtttcggcattgcggcggacctcttcgtccgtcagctgtttcctggcggcggattttcctgttggatcaccgattttccccgtgaaatcgccgatcaggagctggacgatatgtccgttttcctgaaactgacgaagcttattcaagacgacggtgtggcccaaatgtacgtcaggcgcagacggatcgaggccgagcttaattttcagcggttcgccggtcaaaatcgatttggccagctttgcccgcagttcctccgggggaatgacctcctccgctccgtccatatataagtgaagctgcctttcgacttcccgcttttcggcagttgtcagttgatcaaattgttgttgctgcatgataactcctcctttttttgtataaaaaaagaacctcatcccgataagggacgtggctcaaatgcacgcggtaccaccctgattgaagaccttcatcttccgctcaatttccggtaacggcttcccgttctttgctacttgaaggttcacaaagaaagctcagggaggtaattcacgtctgcctttgtaccggctcgcaccagccgccggctctctggaacagggagacagtccgctactcgttcccgtcgttgcttatggtttatgaagattgtcattcacttttcgaaggagctcgatcaatgtattctgctcctcttttgtcatgcccttgatcagcattgtttcccctttgtggaacgccggataaagctcttcaatcgcggcttttccttccggtgtgatctcggcgtaaacgtgtctgcggtctctcggatccgcgcttttgacgcaaaagttctttttctcaagcgttttaatgacattgctcgcagtggctgttgaaattcctgacagttcggcgagttttctcgtttcaagcctgccccatacccatagatcgtaaagaatcgaaaaagccgtccaagacaattgatatgaggaaaggacctcggtctccattttgacgcggagcttttgcgccgaccggtaaaggttggtggcgaccgaaatggcttcaagattcaaggattcgatcggcatgcgcttcagcttgctgagggtgtcgtgttcttcctgtcgaagatggggggatctattcaatcgtgacgcctgcctttttattttcagaattattagctatgaaatgaattttaacagacggtctccatcaatgcaagcccttgtttgacatgatgagaaaagccggcatcatgatgatgaccggcgcttgtttcagctattttttggtgatctgtttgcggcgcacttcaattcggtcccctttttgaatgctgtcatattgttttttcgagacgaggacggcatgtttctttccgttttgatcttcaatcaacagccaatatcttttttcttttcgttcagagagcgctttttctttgattcctgcggtacggaggatgtttttttgttccgctgtatatccgcctacgtggaagatcatccaatatggaaagtagtaattcaaaaaggctgatccagcaggattttgattgagtgtccgcttgatgcttcctttgtacagggcatcgggaggcagtgtccgctgaatggtgttgaactgactgttcttgtttaagtatcgtcggctcgcagactgtttcatataactgcgcatactctggttgactgaacccgcacgtgtttttagagcgctgttattagccgaggaactcgaagccttcaccccggatgctcctttgctgcctgctgcctctgcttgagcaagaggcagcaagagggacagcgccatgatcaaaataagaggagcgctttttttcttcattgttcatcactgcttttttgttcaactttgtctttgacgacgccctcaagcggctcctgatcatatttaatgtatgggggacgaaagatgaaggcttcctgatcgcggattttaatataaggctgttcgacattttctacattttccacatattttttgaaagtctccgtcttttcttttccatctttcacgtatgctgctttcagtaatggtgctttgtcggattcgctgtcattcacgtaatcaaaccatacgagatcgtatttttgaatggattggtcatctgcgacctcctgtgaacggtctgaagcggatgatgaacatcctgataagggaacggctaaaagcatcgcagccgcggataaagagatcagtttcgattttttcactgtgatcatcctattcatttcggtttcgcttttatatacgaacgatccgggcaaaggtgtcatctattcaaaatagattggcagaaaacagggcgtaacaattgcattttaaacgtaaacaaactgtaaaataccatttctatgaaaaaaggtataatttgaatgtcagaaaaaaatcccattcacggaggatatttttatatgaagaagatacttttttctgtttttgttttggcaggcagcttgctattggcttttaattttgccggtgaagcgagtgctaaaacgaaaaaagtcagcggctatatcacttggtacaacggagtgggcaaaatcggcgctgacggcaagaggctcggccattgggactgcgccacaaagatgggcttcgatgttccgagaaaaggcacaaaaataagagcctattcaaaagcaaaaccgcacaaagtcattacagtctataaatatgatgtcggcagaatgccgggcgctgttttggatgtaagcccgaaagcttttagagctttgggatttccgacaagcaaaggaaaggtagccggacattatacatataaaaaataggagaaatgaagcaagaaaaatcgttttcttgcttctttcaattggcggggtcgaatatgaaaaaagtttcagttgttttgttggcggcagtcattttagccgcaggcgcatttgcggccgtccgctatttcgtcccggaaaaagcggagccggcaaagagcggcggttcagacctgcttgtatcgataaccgatcagaagctgatgaccgcttactatgaaaatcaaaataagctgtatgaagaaaagatgacggattatccggctatggcattagaccggaaaaaacgaattctttactatacaaacaccgataacagcaatgtgaagcatttgatcaggctggatttacagtcgggcaaaaaaacaaccctatattcaggagatgaatatgtcgacgggctcagtttatcggcggacggttcgaagctgttcatgagatacaaccttgcggaggagaggaattttcaccttgcttcctttgatttaaaacaaaaggcgtttcatgtcatctatccatcgttgaaaaacaaggacgaaactgtcagctactatcagtacaacaaagctgacaatcaattcgttatgctgcattattcattgaaggaagactatcaaaaaacagatgatgcgaacaacaaaggcgtgccgcccgaaccgacgaatatgaacatttccatggcgggtgtgaaagatcggcaaaaggtgagaacgatagcaaaatttatcaatgacgtggcaatttcgccggatggaaaaacgattgtctttacagaatcggctgatgatcagaaggcgatttatgcgatggatgccgaaacgaaaaaatacaaagcgatcatttcagatcagcaggcattttcattggtcgattcagcacagccgcaattctcgaaagacgggaaaaagctttactttctcgctgaagcaaaagatgcgaagctgcttgaagatgaaacggggagcgaagcaagggtgagaacgatctattcgtatgatatggatacgaaaaaagtgagcaaagcctgggaaaaaacaaacgggatcatcaacacctttacggtcattgacgaataaacgggcaccagccggcacaaacagactgcgccggctgtttttttatgagccgtttgcctgagacgctgcagcagagcttgtcataatggcgattgctgccgtctgctgtgcttgaataacagcttcaagcgtttgataaagccctgtatccaaaagcgccgggtcttccgttttttcgctcatgtacaagttgacggccgttttcagattcatgtctttctgccacctgaacagtttatcgctgttcaatgcgcctgccatgatagtgatggcatctatgtctttttcgccgttctcaagcagcgcgagcagtccgatttccgggtaatggacaggctttggtcttttatgcttttttgtcaattcatcgtatatccggagggagcgggcgacaagctgatctgaatcctgctccggcataagcgagaggatgtggctgagaaactgcaaatcgttccctttgcgaaaacccgcctggttaagcttttggtaaaacgcttcgatatagtcaatcagttcacctgtctccatatctgaaccggccaaaagcacggagagcgggtagtcgccggcagatgttaaaaaaacgtgcttgtccttcattcctttgtaaatagacaaagcccgattgattttgctgtcatgatcatgctcatcacggtattttgtcaaaagaataagagcggacaaataagtgaaaatactttttttgaatccgttgccggtcattttttcataaagagtgaaaaaaggtctgatatgcgtttcaggttcttcgaagcgtacgtcaaacatagcggcaaaagtgtagcgatgggctgacctcaacggcgaaaatgtaccggcggcctgtttgacagcctcactcagctttaaaaaccgttctttatcaaaaggccgcttgttgacgacatacatggaagcaatcatcattaatgtccgctgatctgtgactttccattttaaatcgctttttaactcagagtaaattgctttatattgatccaatcgctgctgcagtttagcagatgccatttatctatctccttcctaggtttgcgtgtttttgtatatacgaaacaaagggaaataagtttcagggatttggcatcatatcgggcttctgcttaataatatggaaaaggatacagcgcagcaataaaaacaaacgggaagatccttctcctgaaccgcctgaatcgtcggcgcggatatccgtaaccgccgtaaaactgcctttcatctgtcacgtcttcgggaatgaggacagatgcttcctgacggttcaccccttcaagaatgccgtgaacagaactgccgtccttcattttcagcacgacgtgatagtgcatgtatttgcggcataaatcgtgcaaagacctttgatgatcatggggcatcgagcaagcggcatctttcggaacactcatattcctttccatctccttttagatacatggtattcacccgatggatgaatgttccggtttgaagcggtgaagccgtgattttatgtaaaaaagccgattatcatatatgaatcggctttaaagatcaacggtcagcacttcattctgcggcatttgaagcggtcgtcatcgtcatcagaaaagcactttctttttctgcatttgaaccggtcatcgtcagagctgcgggttttatccgttttatccgctttagctgttttatctgttttattcgttttatctgttttattactatccgccgaacgccgcgctttcattgactgtctttctttttcccgctcagggctgtatggatcgtaattgtcatagtactcttcgtagctgctcattttgaggcaatcaccgcctttgggtcatgatatgataatgtattataaagaggggcgttttgcctgtgcatatataacggtttttcgtgctgtaaataagctgatcaactgacaaaattcaacattgaataaaggatttttcgtttcaaccgctaatattatatgtatcaaccatttttttacggctgcgcctgccggtgcttgcggaaagcattcagacggacggcctgatatgatagaaggagcggaatgccgatgaaacgatccggaagtgaaggagagtacttatgaaaaatagtagaaaaaaagagatcttatcgtgggtgaaaacacttgtcatcgccgcagcgcttgtgatggtttgccgctattttctgtttacgccgtcaaccgttttgggagattcaatgtatccgactttagaggacggcaacatggtcatggttagtaagatcagcgatattcagcgctttgataaaattatttttcacgcgcctgattcggatgaaaactatgtgaaaagggtgatcgggctcccgggagatacgatcgaaatgaaggatgatgtcctttatataaacggaaaagcatacgatgaaccttatttaaagaaaaacaagcaaaagctgacgcttcatgaacatttaaccgataatttcacattggagaaattaacaggtgaacaaaaggtgccggaagatcacttgttcgtgatgggggataaccgtcaaaacagcaaagacagccgctttttcggatttatcacaatggactccgttgtcggcaaagttgagttccgttatttccctttcaatgagatcggcggaatagaatagaaaacaaaaaggcttcccatgatacctaatgggaagtctttttgtttgtcgcaaagtcaccaaaagtggtttaaaccaagccgctatgcttgagcacggcggcaattctactattcacttaaatttaaattagagccagtttttgatatcgcagttgcagaattaggtctctctgaattataaggattgcctttaatttggtataaaagcctgtttaatcgctgattacccaaacaaaaataactaaaaaatcctcgatttaacaatttagtgtatggtactctttaaacatgtaatcaaaaaactatctttttcgctccaaagcaacataccgtatttcttggtttgttttttagttgttctaaatattttttattgttatcgcaattcttacgttgtttgctgcaatgattgaagtactatattacataaattctgataggaggtcattatgtttaatagacaacagatagatcatctgcttgaagaaaaaaaaggagagctgaagaaaaagttcggaagtggttttatcgcagttttctatatttctattcttctttccatatgtacgttttttatagaatacaaatattttctcattgtattattcgcacccactattattgtcatgttaatcaaccctcctttttccgaaaaaaaaggggtgtttcgtttcattgccggcctttatttgcttttattggcactggcaacatacttttggcttcgagcataaacagtccggatataaaaaacaaaagtggcttcagcccgcggagaaaaggcgaatttacgtttaacattgctgccaaaatctcaaaaatccggcgacttgacttgaaagagtcctcatcgccagaaaacagaatgaattgcataaaaataggacagaatataaaagtccgacctattttgtcaacgatctgaaaggctgcctgcagttaggatgggaagcctttttagcatttgcgcattttggcgagcggacggtttgaacaattatctggacagtgaaataatgaaataagaaactggcaacaaggaggataagcagatgaaagtgtttgtagtgggggcgaacggacaaatcgggcgccgtttgacgaaaagtttgaatgagagcagcgaacatcaggtcagggcaatggtgagaaatgaagagcaggcgcaagctttgaaacaatcgggaacagaaacagcgctcgctaatttagaaggcaccgttgaaagcatcgcagaagcggcggagggctgcgacgcgattgtctttaccgccggctcaggcggcaatacgggcgctgacaaaacgcttttggtcgacttggatggggcggttaaaacgatcgaagccgccgaaaaagcaggcattcgccgctttattatggtcagcacattgcaggcacaccgccgtgaaaattggaatgaagcgttaaagccgtattatgtcgccaaacattatgcggatcggatgcttgaaggcagcgaattaaactacacgattatccgtccgggaggcctgttaaacgaaccgggcacaggccgggtgaaagccgcggaaaatcttgagcgcggaacgattccgcgtgaagatgtggccgataccatcttggcggcgctcaccgaggagcacacattccgtcgttcgttcgatttggtttcgggtgatcaaacgcccgccgaggcgctgaaatctatataaaaggattcggggaacctgtggtcagaaggttccccggcgtttttacagaagcgggatatagatggtcatcttcatctcgttcggcggtacggaacggcacacatcagtcacttcaaagtccggtccttctgttctctcgtaattggtattcatcagccatgatccatagatgtatcttcttgtgttctgcactgattcagtcgatccgtttacatgaaatacggcgtatttgccgccgggaattttcgtataaataagcggctccggcacttccccggctgctgtttcgcgaacggcttccccgataataaatgagaaacctccgtcatcctggaagcggcatgacagcccgtaacacatattcggatccgttttttgaggaatttgcataaagtatccatttctgccgaaatcgttgtagaatttcgggatatcttcgaaatacttttcatcgtttaaatttgtccggtactcatatccgatcatatgtatgtcgtttaaatgagtgatgtgcggctttgggatgttcatatctccagtcatcctttctttatattcgaggaaattaattttagattgaaaatcaagcttgaccttcgctttgcgatacttggccggagtgatgccgaagtactgtgagaaagccctgctgaaagcttcttgtgagccatagccgaaattgattgcaatgtcgagaatggaacggtctgttttctcaagcagaagcgcagcttcagacagacgccggttgcgaatgtattgataaacggaaaaaccggagatcgcctgaaaaagcctttgaaaatgaaatggggagaaacacgatttagccgcaatatccgtgatgtttaaatcgttttgaaggtgttcttcgataaactgaaccgcgttttgagttctttcgtaatcattcatattcatccacagcctttacgatttgatgatcctattgtacaggatcaagcgatggtttttttgatgatttgtgcttttttaaaagcctccaaatgcggaggctttttcttattgatgacgaacatctgtcacttcaagagggcgcatcatatcgtaatcttcgtgctcaaggatgtggcagtgccaaacatatctgccgctgtacggcgcaaaggtggcgataatgcgcgtcactgaacccgggggtactttgacggtgtctttcagccccttttcattcggtgccggaggaactgccggaccggtaaaaacaagttctccgttttcctgataccgctcgatatcaaacggccggtggtcgagaatcataaattgaacaagatgtaaatggatcggatggatcgcccttccggcattgatgatcgaccagatctcagtgctgccgagtgcgggtgtttcggttaccggttcatgccactttgtgttgtttaaaagcagaacaggtcttccatattggtcaacggccgcgcccaatgacagatttctgagggcattgatcttgtgtctccggtaaaatgggcgctttctcaatattctcggcaatgaacttgtatctttttgcttcaaaggttttgagatgcggaattgcatgatgtcggcatcagtatcgggatctgcgtcttgtccgccgcagccgatccggtttttcagtgtcacggtttttccttctgctcgtgaaaaatcaacgatgatatcgcacctttcagccggcgcgatcaccagttcattgactttgaccggatgctgcagaagaccgccgtccgtgccgatttgatgacatgtgatgtcatgatcgaaatacagctcaaagattctcgtattggaggcgttcagtatccgaaaacggtattttcggggttccagttcagcgaaaggccataccttgccgttgactaaaatggtatcaccgcaaaaagccggaacaatcgacgggtccggaagatccggcgaagggttgtcaggctgccgcggataaaacaatgaaccatcttcatgaaatgatttatcctgaatcaaaagcgggatttcatattctcccttcggcaagttcaatgaacgctcttccctgtcgcgaataaaatataaaccgacaagccccgcatatacattcagccttgtgatggccattgcatggtcatgataccaaagagctgtagcatcctgctcattcggatattcatacacctccctttcaaagaaagggccttttgcatggaagtcttttgtgtaccaagcctcaggatatccgtcgctgtcagcaggcgtacagcctccgtgcaaatgaacgaccgtcttcacttcatgttcgtgatggccgtcatcgtgaagcgtatggtcgacggggagaaaatggcgatccggaagcttatttaaccacttgactgcgactttttcgtgtttctgcacttcgaaggtagggccgggataaactccgttatatccaaacagccgagtcggcggcagatcgcggtgaagctgctgctgaaattctttcatggtgacttcataataggtcatttccttgcttttgctttggggttgaagcacttgcggaatggggagccggtcaacgaatttttcaagtttcatgtttcacctgtcctcttttgttctgatgaaaagatcattacattataagacgggttgcatggtctggttcctcatgatgagaataagaaacgcagtatgtgctgagtatgttaaaaaatagaatcgatcattacaagaagatgaacaaaatatttcctgacgattaaaaatcgccttgaggcgtgattcgcggaggaagaaaggcggggatgatggtacattatgtgtaaaccctttcttatggggcgaagcggtctgaaaggagatacccgtgttgcagaaaagaatagagtggattgatgtttcgaaaggcgtgggaattatattggtcgtattgggccatacaccgacgccggattggctgaaaacgttcattttcgcatttcatatgccgctgtttttctttctgtccggcctcgtttaccatgatgggaatatgacttttacatcttttctcttaaaaaaaataaagacgctccttttgccgtacttcatcttctccgttcttgcctatttattctgggttctcgtcgagaggcattttacgttcaccggcagttcggatgtcgacccggttgtaccgtttaaagggattttttattcgatgcctgatgactacatgctgacacacaacccggcgctctggtttttaacatgcttattcatcgttgaaatactgtttttcatcgtgaagagatgggggaaaggcagactgtttatcgtcatagccgtattggtctcagccgctttaggctttttgaattatcaatatctcggcatcaagctgccgtggaatattgaagtggccctgaccgccatcgtcttttattcggccggttttctgttgaaaaataatctgaaagagatgagagaccgaagaatgctgctgctcacgcttcttttattcatcgcggtcggctgcttgcagaccctgaacgtcagagtggatatgagggccaatgagtacggaaacatggcgctcttttatatgacctcatttctggggacggcaggcgtcattttcagcagctttcaccttgaaaaagcaaggcttctccaattcctcggcaaaaactcgctgatcattctcgtactgcactatccggtcatcaggatgctgaaagccgtcgtctactacttcacacaggtttcccttgatgagacatacggctccctgttgtggagcgcgctttacaccggcatgacattgcttgtaatggtgccttgcatctttttgttgaaccggtatccgatcgtacttgggcggaagaaatgcaattaaaaaaacttgcaaagttttctttgcaagtttttttgaattatttaaggttgaaagtaatctttttgtcattccaaaattcaggagtgtagataactttatatgttttgctctttttagtctcgaaagtgattgttccagataccttgccgtttggtgtcagatttccagaagataggtcgttatcatctgatggtccaaacgtattgtgcgtaatttgtccatcttcattttgaatttgaaaatcgagcgggttataggaaatatctttatcgcttttattttctatgttaagtgttgcaactacatattcattaccgttttttggtttgaaatattcattgcccatcgattttttaacgttagtaactgtgatgtgtgtgccgtcaagatcagctgtttcatttaaaccgaattcagttttttctttggcatcgtcattgcttttttcttcgctagtttttgcggctgtcgtctttgcgctgcttccggacgatttgctctcttgagtagaagagccgcttgaagcgaacatcatgacgaatacgatggagccaataatcgtgacatcgaaccaccatttttatagacaaggcctttattcccgccactgaacaatgctttacatccgccgattaaaagcaggataagcggaacgatatatgccaggctgacgccgacagttcctcctattgcagcagcgatataaaaaggttgctatctgcgctggccattgtcggtgcatgtatcgtaatgtccacctcataatctatgtaataatgtctgaaacataataatccaaaaaaaggaaaaagtctattttattatgatattttaatcgtcagagctttaaggactattttcgacttttttaatatcgtttaaattttgagtttgtttaatgtttttcagaagaatcattcatggattctaaagaaaaaatattctgaaagaagaaaccgtcctttccatcctatgacgcttgaataatttgaggttttcgaaaaatccttatatagagcgggttttaacggttttgaccaaactgaaatttgtttccttaaataaaaaaagttctactctgactatatttctgcaagaagtgaatcatgtttctatagactcactcaagttttgctttgtatgattaaaagcgaaaactcggatgggaaaggaagctttttatggaacggtatgatgaattaaaaaaaggtgaaaccggggcatgggtcagcatcatcgcttaccttgtactgtcggctgttaaattggccgtcgggcttgcatttcactccgaagccctcagagccgacggactgaacaatacaaccgatattatcgcctcattagcggtgctgatcggcctcaggatttcgcagaagccgcctgatgaagaccatccgtacggacatttccgcgctgagacgatcgcctcgatgatcgcttcatttatcatgatggtggtcggtcttgaagtgctgtacagctcgggcgaaatgctgtttaatccgaaggaaacgacaccggacatgattgcggcctggacggctgcaggcagcgccgtcgtgatgtttttggttttcctctacaataaaaggctggcaaaaaaggtgaacagccatgccctctatgcagccgccgccgataataaatcagatgcctatgtcagcatcggaacattcgcaggcatctttgcttcgcaatttaaccttgcatgggtcgatacggcagccgcgtttatcattggattaatcatctgcaaaacggcttgggggatttttaaagaggcggcccattccttgacggacggattcgatattaaacatatttcaacctataaagaaacgatccggaaagttcccggcgtcggcaacatcaaagatgtaaaagcgcgttatttgggcagcgccatccacgtggaaattatcgtggaggtaaggtcagatctcaacattgcagaaagccatgacatcgccgatgaaatagagagaagaatgcaggaggagcactcgatcgttcattcccatgttcacatagagccttctaaagaaaaataaaaagcggtcactgaccgcttttttttactttcatcactctgtaaattcgaaatgaaaaaagacaaaattctattttccgccagtcagttgttttctgggagcacatcgtttatggtaaagttaaataaattcgattcgtcagcaatgaggaggaagaggatgtcatacgaagaaatgctgcatcccgttttgggaaaagtagctgataatattgacaaagtaatggtaggaaagaaacatattgccgttttaagcctgactgccattcttgcaaacggacacgttctgctggaagacgtacccggcgtcggaaagacgatgatggttcgcaccctggcaaaatcaacaggcgctgaatttaaaagaatccagtttacgcctgatttactgccttcagatgtaacaggggtttccatatataatccaaaaacgctggaatttgaataccgttcaggtccgattatgggggacatcatcctcgccgatgaaatcaacagaacatcgccgaaaacccagtcggcgcttctggaagcgatggaagaaggaagtgtgacagtagacggtgtgacaatgccgctctcaaagcctttttttgtgatggccacgcaaaaccctgtcgagtatgaggggacatacccgctgccggaagctcagcttgaccgctttttattcaagctgagaatgggatatccgacagtccgcgaagagcttcaagtgctcgatcttcaggaaaaccgcagccccattgaggaaattgagcctgtcatagagaaggaagagcttgccgcatttcaaaaagaagctgaaaaggtgtatgtagacgctgcgattaaagaatacattgttgggatcacccaaaaaacgaggagtcattccgccgtttatctcggggtgagtccgcgcggctcaatcgccttgatgaaggcggctcaggcgtttgcatttttatataaccgcgattatgtcattcctgatgatattcagtatttggcgccttttacccttgcgcacagaatgatcctgcggtcagaggcgaaatttgaaggaaagcggcctgaagctgtccttcaggacatcatgtcaaaaaccgaagttcccgtcggaaggccgatgagcagctgatgagagagcgcatcggtcttgtgatgtacggatggaagctgtttattctgtttcttctgtttgcttcaacgttttgctatgcgatgtttcaagggggatttgtcagctggtttctgttctactcatttctcccctttgcgctttatgctttcctgtttgctttttatccgctgaagaacttgacagcggagcggaggctgagccaagggcagtataaagccggtgatcaattggaggctttcgtcgtgctgaagagaaaatggccttttccgatcatgtttatgatcgtggaagactgcctgcctgattcgctggggaaaaacaggggttcggcagaggccaaacagcttctctttccttggtttaaaaaagaaattaaaatggcgtacacgatcgattcggttccgagaggagaccaccgtttagcaaaaatcagagtccgtacaggtgatccgctcggcctgctggaaagggaatgcgagattcaattggaagcttcctttctcgttttgccttcctatcaggagatcgcttaccgcgccagcggaggctcttatgacgagcatgcaggccgcgtttcagagcttcgccgcaaggacagtacactggcgtcaggtatcagagaatatcagccgggcgaccgttttgcatgggtcgactggaagacgtcagcccgccgcagccagctgatgacgaaggaatttgagcagacgaaaggggatgacctgctcgtctttatggatcagtccccgtctgaggcttttgaagagatcgtcacgtttaccgcttccatcattcgttcggcaatgcggagcgggacgaatgcagggcttgtttccattggtaaggagcggaatgtcttcccggttcggcagggggaagagcagctgagaaagctgttctactacttggcgattgccgactgcaatgcagtccagccgtttcacagtctgatagagggggaattgggacattccgatatgagaaaagccgtcaaatatattgtgacaagccgcatcacgatcgaactggtgcaggctttgaagaaaccgctctccggcgggcggcccgtcatttgtttggtgaagaaaaaaggcggagatctatcaagcgaggaaagcgcggctgtccagcatttaaaagcgcggggaatcgaagtaaacgtcatttacggggaacatttttcccggggtttggctgaagcgaggtgagaaaatgttgtccgggggaaaaagaaacaggttcggtttattgcttttttatgtgctgacttttttgctgctgtgggagtggctccgtcctttgcagtattttaccgatacggggcacaccgtcttttttattttatttatcgctcttgtatttttgcttacattttttaaggtcccttggtttatcagatttccggtcagccttggcttcgttctgtttgcactgcacacgattttttacgaaggatcggtgttttcaccttcatggattgccctgtttttccaggatttaaagcgaaatttctcctatattttctccggcatgtggcgggatatgtcgccgttgtttcggacgctgctcttttacgtccttctttggctgctcgtatacttgctgcactactgggtgatctatcagcgcagaattttattcttttttattatgaccgttgtttatgtcgcggtgatcgatacatttacgccgtttgacgcgtcatatgcgatcgtcaggatcgtgctgatcggctttttgcttctcggcctgctgtatttggaacggatcagggaatcagaagcgctcaaatcctcgaaatcgcggtttgccaaatggtttgcaccgctcttattgatgactgccgccgccgtgtgcatcggcgcggtctcgccaaaagccgatcccgtctggcctgctccggtgccgtttctgcagacggctgcgaccggcgattttgcttcctcaggcagaagcaaagtcggctatggaacgaatgatgaggcattgggcggtccattttcaaaagacgatacatgggtatttacatggcagggaaatgaacgaagctatttcagggtggaaacaaaaagccgctatacaggaaaaggctggattgaagacgaaaaatcaggcgcatccattcagcttgaagaggataaactggattaccagtggtacgacgaaagcgtgaagaccgaaacgcgcaaagcgatcgtcgatatcgatcccgcttaccggtacgatcatgtcctgtatccgatcgggacgaccgaaatcaagctcaataatttctttgtgccgctccgcatgaacttaaatacggagaaaataaaaccggccggcaagacaggcgcggacattcagaatctggaaagctattcggtcacctataaatcacccgtctttgatgtcgatcagctgaggaaagtcagcttggagtcggaggggaaatgggccaggagccatgagaagtacctgcagcttcccacttcccttcccgaccgcgtgaaaacattggcgcacgatttaacgaaagacgaagataatatatatgacaaagcgaaagcgattgagaagtatctcggttcttccgaattttcttatgagacggaagatgtcgctgttcctaaaggagaccaggattacgtcgatcagtttttatttgagacgaaaatcggctactgcgacaatttttccacggctatgatcgtactgctgcggtcggccggaataccggcccgctgggtgaaaggctacacatccggtgaatatgcaggaacgacggcagaccggaaacgcacgatgtacgaggtgacaaacaacaatgcccactcctgggttgaagtgtattttgaagggcaaggctgggttacgtttgaaccgacgaaaggctttttaaatcccgagcagctcgttgaagagtccagcggtcagcaagccggcgcggcttctgataaaaaagaagatgataagaaaaatgatgaaggccagcgtccgcaggatgcaaaagaacaagacaacaaagagaagcccgaatcccaggcaaagcgtgatgccaaagccgattcccatgccggaagcgatgatgcagaccgtactcttttgactggtgcggccgtactcggtctgttgctggcgtttgcagcggtgctttactatacaagggtgaaatggatgccgcacatcatcatcaacaggctgaaaaaacggcgtgatgaagcggttttctttaaagcctacgacgaactgctccgccagctgaagcgccaaggcatgcaaaaagaagaaggccagacgctgcgcgagtttgcgaagacggttgatgaacgctttcaaagcggggacatgacggctttgactcttcaatatgaacgggctttgtatcgaaaggaagacgccgcaaagctttggaatgattcggcggagttatgggaaaatttaattaaaaagagatagtcttgaccgctttcagtcgtattgttagaataagtgaatattaaaaacccttatatattcttgctggcaggctcggcggcttatctatcggacaagccgggccttgtcccgtgaatgggggcaggacggccgtgtgtctgccgccattttttctgtgcaaaaagacaatttgataaagaggtgacaccatgacgaagttagtaaatgaaatgattcttgtgttggattttggaagtcagtacaaccagctgattacccgccgcattcgtgagtttggtgtatatagtgaattgcatcctcatacgttgacggcagaggaaatcaaaaaaatgaatccgaaaggaattattttgtccggcggtccgaacagcgtttacgacgaaggatctttccgctgcgacgaaaagattttcgaactggacatccctgttcttggaatttgctacggcatgcagctgatgacgcattaccttggcggaaaagtagaagcggcaagccagcgcgaatacggaaaagcaaacattcatatcgagggtgaaccggatctgtttaaagatcttccaaacgaacaagtcgtctggatgagtcatggtgatctagttgttgaagttccagaaggctttaccgttgatgcgacaagccatcattgcccgaactcagcaatgagcaagaaggataagaaatggtacggcgttcaatttcatccggaagtccgccattcagaatacggaaacgaccttttgaagaacttcgttttcggtgtttgtgaatgcgtcggcgaatggtcaatggaaaactttattgagattgaaatgcagaaaatccgcgaaacagtcggcgacaagcaagtactgtgcgcgttgagcggcggggttgactcctctgtcgttgcggtcttgatccataaagcgatcggcgaccagctgacttgtattttcgtagaccacgggctccttcgaaaaggtgaagcggaaggcgtgatgaaaacgttcagtgaaggcttcaacatgaacgtgatcaaagtggatgcgaaagatcgcttcctgaacaagcttaaaggcgtctcagaccctgaacaaaaacgcaaaatcatcggtaatgagtttatctacgtgtttgacgatgaagcggaaaaactgaaaggaattgacttccttgcacagggaacgctatacactgacattatcgagagcggaacagcgacggctcagacgatcaagtcgcatcacaatgtcggcggccttcctgaagacatgcagtttgaactgatcgaaccgctgaatacgctcttcaaagacgaagtgcgcgcgctcggaaccgagcttggcatccctgacgaaattgtttggcgccagccgttcccaggtccgggcctcggcatccgcgttcttggagaagtgacggaggaaaagcttgaaatcgtccgcgaatcagacgcgatcctccgcgaagaaatcgccaaagctgatcttgaaaaagatatttggcaatacttcaccgttcttcctgatatccgcagcgtcggcgtcatgggagacgcaagaacttatgactatacgatcggcattcgcgccgtgacatcgattgacggcatgacatcagactgggcgagaattccttgggatgtccttgagaaaatctcgacacggatcgtcaatgaagtgaagcacattaaccgcgtggtttacgatattacgagcaagccgcctgcaacaatcgagtgggaataagaaaaatgcctcagccgcatgaagctggggcattttttattggtggagcagtagattggatgatataacgcttatatcttccgttttcatcgccgcagccgctgtgccatgaatcttccgatcacagagtgacaaccgaacaaggcattaaagtctacgatacagttcaaacggtgttcgaagcgcggtcttgtcggaggatatgacgcggaaacagaatatcacgctaaaaaaagagcgtgttttatttgaattgaaagaaaaccggggattgagccccttcagaccacgatcagaatttggaaaaacaacgaacgaagcgaacattaaaatcatgaatgttcgtttttttgtattgtgttcaacgttagatattgctacaatagtatagtaatttaaaaaagacttgtcgtataatcatggggatatggcccataagtttctaccaagctaccgtaaatagcttgactacgcttgtatacaatattttatccgtgaaaaatcattttttcagtatgaaatatgccgtagtcaagcgtcccgccagttggggcgttttttgtttaaaagcaaaggtttatgaaacaataaaagcgacagacaaacgagaggagtataccattttgaagcgttactttcagtttgaagaattgggcacaaattatcggagagaaatgatcggcggactcaccacatttttgtccatggcatatattttgatcgtcaacccgcttaccctttctctggcgtcggtggaaaatttcccggatgcattgagaatggatcaaagcgcggtctttacggcaaccgcggttgcagcagccgtcggttgttttatcatggggctgctcgcgaagtatccgatcgctctggcgcccggaatggggcttaacgcattctttgcattctcagtcatcctgaatatgcagattccttggcagacggctctttcaggcgttatggtttccggacttatttttatcgttctttcgctatccggtttaagggaaaaaattatcaattcgattccttatgagctgaaaatggctgtcggtgcggggattggcctgtttatcgctttcgtcggtttgcagggctccaaaatcgtcgtatccaacccggatacgattgtgtcgtttgggaatattcattcaggtcccgttcttttgactgttttcggactgatcatcactgtcattttaatggtattgcgcgtcaacggcggcattttcttcgggatgctgatcacggcgattgtcggcatgattttcggacagattgacgttcctgacaaaatcgtcggtgccgttcctagtcttgcgccaacatttggacaagcctttatccaccttcatgatatctttacggtgcaaatgcttgtcgtcattttaacgtttttattcgtcgacttttttgatacggccggtactttggtgggtgttgcatcacaagccggtttgatgaaggataacaaactgccgcgcgcgggaagagctttgcttgccgattcttccgcaactgtggccggagcgatccttggtacatcgacaacgaccgcttatgttgagtcaagcgccggggtagcggccggagcgagaagcggttttgcggcgattgtaaccggcgttttgttcttgctgtcgctgttcttctcgcccgtactcagcgttatcacttcacaagtgacggcgcctgctttaatcatcgtcggcgtgctgatggtggcgaatctcaacaaaatcgactggaccaaatttgagattgcggtgcccgcattcttcacgatgatcgcgatgccgctgacatatagcatcgccaccggaatcgcgatcggatttattttctacccgatcacgatgatttttaaaggcaaagcaaaagagatccatccgattatgtacggactggctgtcgtatttattctttatttcattttcttgaaataggctgtaggaaaaagcgcttgttcatttgaacgagcgcctttttttatttccaattcatcaaaatcggaaccttccgccttcgtttttcgtcatatataagggctgctgcatctatgataaaaagaggtttgtcttgactgtttcacacagcttatgtaatttataaaagtgcttttcatttatgtaaagcttttgaatagaagaggagttgcttatatgattgaagaacatcacaaacgaaacgaagatgatatagaacaagaacctgcttcgaggatgtcgaggaattcccggaaaaaagcgaagaagagcaaggagacgaatccgtctgcagcaaaagtcaaatcggtgatggagagtgtgattgccgctttgttccgttatttcagctttgtgctcgatattttaaagtccccggtgcgcactgcacttgattatgaccggtcttattttaagtattccgttatttcaatgacgcttttagctgttttcttttcgctcggcaacttttatcagctgcttgcgggccgggggagaattctcgggttcggcgtgtcggtgccgtttatggaagtgtttttggttgtgtttatctactgcatggctttcatgttttggatggcggcagcgagctgggctgtatcgaattttatgctcaggtataaagcttcatttttcgatatcacggcaaagtacggctctttactggttccgtttatcgtccccgccgctctgtggatgattttcgcgattatcaacttcacggccgcgacggtgattctctcgatcgtcatctttatgggattgaccttcggcacttttacattgattcaatcaatttatgaaaaaagcgaaaaaccgcggtttgacctgatgtactgcgtgtttaccgtctttttgcttgaattggtattcgttggggcaacttggaagctggtgggcggatacttgctgtcctcgcttatccctgtataaggagatacagccggttctttaagaagaaccggttttttcttaacattaattctgagttgactcataagaataatatgtattatattgtaaccaatcatacgaacggatgggggagtgatcgatggctaactttcttcgaaaagctgtaaagcaaaaaaaggagtatttaatcaggcagctcgcaaaaccaggacggctggacaatttgaaagacctctcgtcatacacgctgagcgatttggaaaaggaacaccggaagctgcacaaattagatgaagttcgtcagcgggatcataaacaccagctctaaggacgttcatttgaacgtcttttttaatggcgtttaaatgctttgaaaccggcagaaaaagggtaaactgatggaagtgagcaatgtcgaaaaattttgtggtgaagcagggccattacaggattgtgtatggagaatttctctagtagaatatgattgctttgcatctaaaggagggatttcaattgcttcactcagcactattgaacggtgtgatcatggttggaattattctggttatcaatattatatatgtaacgtttttaacccttcgcatgatactgactctaaaaggccagcggtatctcgccgcttttatcgggacaatcgaaatgcttgtttacgtcgtcgggctgggtcttgttttagataatttaaatcaaatccaaaacgtgatcgcttatgcggttggatttggaatcggcatcatcgtcggcacgaagattgaagaaaagctcgctttgggctatattaccgttaacgccattacgaaagagcttgatttggatctgccgaaacagctcagggaaaaaggctacggggtcacccattgggtcgtcggcggacttgagggagacagaacggcgatgcagattttgacgccgagaaaatacgagctgcagctgtacgaaacaattaaatcaatcgattcaaaagcatttatcatttcctacgaaccgaagacgatacacggcggattctgggttaaagccgtaaagaaaaggagaattaaagaataatgacaaagccgaaaaaaaagcgctttgaagtaacggaaggcgaaacgatcgaaaccgtgttgacgaagatgcaggaagaaggctacacgccggtgcgccgaatggaggagccggtcttcaaagaaacaaaggaaaatggaacgattcaggttgttccgtgcggaagaaaaattatattcgaagggaaattgctctaaacccgaacattagaacaacaaaatatactatcgttcgataatgtcgttgacattatcacagtccgttgttaagataaacatgacatgaaaacacatcctcatataatcttgggaatatggcccataagtctctacccgatgaccgtaaatcatcggactatgcaggaaagtggacaataaactgacatggagatcgcgagaagcggactaactgacgatacacgcgccatgcccggtttgtgttgcttcctacaaatgcaatacatgccgggctttttatttgcgaagaataacagctaaaggtgggacaaaaggatatgcagcctcttcttggtgttatcatgggaagcacatctgactgggaaacgatgaaacatgcctgcggcatactcgatgaactgggaattccgttcgaaaaaaaggtcgtttccgcacatcggacgcctgatttaatgtttgaatatgccgaaaaggctcgggaaagaggcttgaaagtcatcattgccggagcgggcggagccgcccacctgccgggaatggtcgcagccaaaacgacgctgcccgtcatcggtgtgccggttcagtcaaaagcgctgaacggcctcgattcgctgctttcaatcgttcaaatgccgggcggagtacccgttgcgaccgttgccatcggcaaagcgggagcggtcaacgcaggactgcttgcggcgcagattttgtcagcttttgacaaagagcttgccgaaagattggacgaacgaagggaaagcatcagacaaaccgtgttggaaagcagtgatcagcttgtataaacaaacgatttttccgggagcgacaatcggcattatcggaggcggacagctgggcaaaatgatggccgtcgcggccaaacaaatgggctataaaatcgcggtggttgatcctgttccttcatcaccgtgcggccaggtcgccgaccttgagattacggctagctataatgacggggaagcgatacggaagcttgccgaagcgagcgacgtgatcacttacgaattcgagaacatcgattatgacgcgctgaactggctgaaggagcacgcttaccttccgcaggggagcgagcttttgctccttacgcaaaacagggagaccgagaaaaaagcgattgcatcagcgggctgcaaagtcgcgccgtaccggatcattcacgaccgggcggaattggaagcgtccgtagcggagctcggtcttccggcggtgctgaaaacttgccgcggcgggtatgacggaaaagggcagcacgtcctgaaagaacaagcacaaatcggggaagccgcagctcttttacagcacggcacatgcattttggaaagctgggttcctttcaaaatggaattgtccgtgatcgtgacaagatcggttcacggagagacaaccgtctttccggcggcagaaaacatccataaacaaaatattttattccagagcatcgtcccggcccgggtcgatgaggcgattcaggaacaagcggcagtacttgccctcaggcttgccgaaaagcttcagcttgtcggaacactggccgttgagcttttcctgaaggaagacggcggccttctcgtcaatgaactggcgccgcggccgcataattccggccattacacccttgatctttgcgaaacgagccagtttgaacagcatatccgggctgtctgcgggctgccgctcggcaaaacggaccttctgaaggaaggaatgatggtgaaccttctcggagacgaagtgtacatggctgaagaagaccccgaacttttaaaagaagcgaagctttatatatacggaaagcatgaagtcaaaccgggtcgcaaaatggggcacatcacatttttaagaacacccgacgatgaatggatcgggaagatgacagaaaagtggactgaaagagatggaggacgaaaacaatgatcgaacgttattcaagaccggaaatggctgcgatttggacagatgaaaacagattccaagcatggcttgaagttgaaatactggcttgtgaagcttgggctgagctcggcgtcattccgaaagaagatgtgaaggttttaagggaaaaagcgtcatttgacatcaaccgcatcttcgaaatcgagcaggacacgcgccatgatgtcgtcgcatttacccgcgccgtatcggaaacgcttggcgaagagaaaaaatgggtgcactacggactgacatcaacagatgtggtcgataccgctctttcctatctattaaaacaggcgaacgagattttgctcaaggacattgagaggtttattgacatcttgaaagaaaaagcaaaggaacataaatatacggtgatgatggggcgcacacacggcgtgcatgcagaaccgacgacattcggcttaaagctcgccctttggtatgaagagatgaagcgcaacctggaacgcttcaagcaagcgaaagaaggcatcgaagtcggcaaaatctcaggcgccgtcggaacgtacgcgaacatcgatccattcgtcgagcagtacgtatgtgagaagctcggcttaaaagctgcgccgatctcaacgcagacgctgcagcgcgaccgccacgccgattacatggctgcactggcgcttgttgcgacaagcatcgagaaattcgccgttgagatccgcggcctccaaaaaagcgaaacacgcgaggtcgaagaatttttcgcaaaaggccaaaaaggttcatctgccatgccgcataaacgcaacccgatcggttcggaaaacatgacgggaatggcgcgcgtcatccgcggctacatgctgaccgcttatgaaaatgtaccgctttggcatgaacgcgacatttcgcattcatcagcagagcgcatcattctgcctgatgcgacgatcgcgctgaattacatgctgaaccgcttcggcaacattgtgaaaaacttgaccgtgttccctgaaaacatgaagcgcaacatggaccgcacactcggattgatctactcccagcgcgtccttctcgctctcattgataccggcatggcgcgcgaagaagcgtatgacaccgttcagccgaaagcaatggaagcatgggagaaacaagtgccgttccgccagcttgtcgaggctgaggaaaaaattacgtcccgactgtctccggaacaaattaacgactgctttgattacaattaccacttgaaaaatgtcgactacatttttgaacgtttaggcttggcatagaatagaccgcccgcttttacaggcgggggtctaagtgcttaaatatttccaacattcgggttaggaggccttctgtgaatattgtgaaaaatgaacttttatacgaaggaaaagcgaaaaagatttaccggacggatgatgacaacactttgtttgtcgaatacaaaaactcagcgacggcttttaacggagaaaaaaaagccgagattgacggaaaaggccgtttaaataacgaaatttccagcctgattttcacaaggcttcacgagaagggaatcaacaaccactttgttgaacgaatttctgaaacggagcagctcattaaaaaagtgacgatcatcccgcttgaagtcgttgtccgcaatgtcgttgccggaagcatgtccaaaaggctcggcattccggaaggcacggagctggggcagccgattatcgagttttactacaaggatgacgcgctcggtgatccgttgatcacagaagaccatatccggattttaaaagcagctgagcctgaacaggtggagaaaatcaaatcgattacgagacaggtaaacgaagagctgcagacgattttcgcggcttgcgatgtcagattgatagatttcaagcttgagttcgggctcgataaagacggcgaggtcctgctggccgatgagatttccccggatacgtgccggctgtgggatcaagaaacgaatgaaaagcttgataaagatgtgttcagaagaaatctgggcggattgacggatgcatacgaagaaatattcaaaagacttggaggcatgtaatatgtacaaagtgaaagtgtatgtcagcttaaaagagagtgttttagatcctcaggggagcgccgttcagcatgctttgcacagcatgtcctacaaagaagttcaggacgtccgcatcggcaaatacatggagctcacaatcgaaaaatcggaccgcgaccttgacgttctcgtcaaagaaatgtgcgaaaaacttttggccaacacggtgattgaagattacagatacgaagtcgaggaggttgtcgcacagtgaaatttgcggtgattgtgctgcctggctcaaactgcgatatcgatatgttccacgcgattaaggatgagcttggcgaagaagctgaatacgtctggcatacagaaacaagtcttgatgaatatgacggcgtcctcattccgggaggattctcatacggtgattatttaagatgcggcgcgatcgcccgcttcgcaaatattatgccggccgtcaaaaaagcggctgaagaagggaagccggtgctcggcgtctgcaacggatttcaaattttgcaggagctcggtcttttgccgggcgcaatgagacgcaacaaagatttgaaatttatctgccgtccggttgaactgatcgtccaaaacaatgaaacgctttttacatcttcctacggcaaaggcgaatccatcacgattccggtcgctcacggcgaaggaaacttctactgtgatgaagaaacgcttgccggattacaagaaaacaatcaaatcgctttcacatacggaacggatatcaacggaagcgtcgccgatattgcaggcgtcgtcaatgaaaaaggcaatgtattaggcatgatgcctcacccagaacgcgcagtcgattctctgctcggaagcgccgacggtcttaaactgtttcaatctatcgtgaaaaattggagggaaactcatgtcgctactgcttgaaccaagtcaagaacaaattaaggaagagaaactttatcagcaaatgggtgtcagcgatgacgagtttgccatgattgaatcgattctcggaaggcttccaaactatacggaaatcgggattttttcagtcatgtggtcagagcactgcagctacaaaaattccaagccgatcctgaaaaagttcccgacaaaaggcgaacgcgtcctgcaaggaccgggggaaggcgcaggaatcgtcgatatcggcgacaatcaggcggttgtcttcaaaatcgaatcgcacaaccatccgtcagcgattgagccttatcagggagctgcaacgggtgtgggcggcatcatccgcgacgtcttttcaatgggcgcgcgtcccatcgctgttttgaactctctccggtttggcgaactcacttcaccgcgtgtgaagtacttgtttgaagaagtagtcgcgggcattgccggatacggaaactgcatcggcattccgaccgttggcggggaagttcagtttgacggctgctatgaaggcaatccgcttgtcaacgcgatgtgtgtcggtttaatcaaccatgaagatattaaaaaagggcaggcgaaaggcgtcggcaataccgtcatgtacgtcggcgcgaaaacggggcgcgacggcatccacggcgcaacgttcgcctcagaggaaatgtctgaccaatcagaagaaaagcgctcggccgttcaagtcggcgatccgttcatggagaagctgcttcttgaagcgtgtctggaagtcatcaaatctgacgctttggtcggtattcaggacatgggtgcggcaggcctgacaagttcaagcgcggaaatggcatccaaagccgggtctgggatcgagatgaaccttgacttgattccgcagcgcgaaacaggcatgacgccgtacgaaatgatgctttcggaatcccaggagcgcatgcttttggttatcgaacgcggccgcgaacaggaaatcatcgatatttttgacaagtacgatcttgaagccgttgctgtcggccatgtgactgatgacaagatgctgcgccttttccataacggagaaatggttgccgagcttccggtcgatgctcttgcagaggaagcgcctgtttaccataagccgtcaaaagtaccggattattacaaagagttccttgaaacagacgtccctgcaccaaaagtcgaagatgcgaaagaaacgcttctcgagctgctaaagcagccgaccattgcgagcaaagaatgggtttatgaccaatatgactacatggtcaggacgaacacggttgtcgcaccgggctctgatgcagccgtcctcaggattcgcggcacgaaaaaagcgctcgccatgacaacggactgcaatgcccgctacttgtaccttgatccggaaacaggcgggaaaatcgccgtcgcagaagcggcccgcaatatcgtctgctccggagcagaaccgcttgccgttacggataacctcaactttggaaatccggaaaagccggagatcttctggcagatcgaaaaagcggcagacgggatcagcgaggcgtgcaacgtgctcagcacaccggtcatcggcggaaacgtctctctctacaacgaatcaaacggaagcgcgatctacccgacgcctgtcatcggaatggtcggattgatcgaagatacggagcatattacgacacagcactttaaagcagcgggcgatttgatttatgtcatcggcgaaacattccctgagttcgccggaagcgagctgcaaaaactgaccgaaggaaagatttacggcaaagcgcctgcgattgacctggaagtcgaacaatcgcgtcaaaaagctcttctgaaagcgatccgctccggactcgttcaatcggcgcatgacgtctcagaaggcggcatcggcgtggcgctggcggaaagcgttatatcttctcaaaggctcggcgcccatgtgacgcttgcaggcgaacctgcattgttattcagcgaaacacaatcacggtttatcgtctctgtgaaaaaagaccatcaagaagcgttcgaaaagcttgtcaaagacgccgatctaatcggtgaagtaacgtcagacagcgtgctggctgttcaaagccaggaaggacaacaatggattcatgcgcagacagaagagctcgaaagcgcatggaaaggagctatcccatgcttgctgaaatcaaaggcttaaatgaagaatgcggcgtatttgggatttgggggcatgaagaagcaccgcaaattacgtactacggccttcacagccttcagcacagaggccaggagggcgccggcatcgtcgcgacagacggcgaaaaaatgtccgcccacaaaggccaggggctgattaccgaagtttttcaaaacggtgagctcaaaaaggtgaaaggaaagggagcgatcggccacgtccgctatgcaacggcgggcggcggcggcttcgaaaacgtccagccgttccttttccattcgcaaaacaacggcagccttgcgcttgcgcacaatggaaacttagtgaacgccactcagctaaaacagcagcttgaaaaccagggcagcatttttcaaacgtcttcagatacggaagtgctcgcccatttaattaaaagaagcggccacttcgagctgaaagatcaaatcaaaaacgctctttctatgctgaaaggcgcttatgctttcctgatcatgacggaaaaggaaatgatcgtggcgcttgatccgaacggactcagaccgctatctgtcgcaatgcttggcgacgcgtacgtcgtcgcttctgaaacgtgcgcatttgatgtggtcggcgcgacatatctgcgcgatgtagaaccgggcgagatgctgatcatcaatgatgaaggcatgaagtcagagcggttctccatcaacatcaaccgttcgatctgcagcatggagtacatttatttctcaagacctgacagcaatattaacggcattaacgtccacagcgcgagaaagaatctcggcaaaaagctcgccgaggaatcaggcattgaagcagatgtggtgacaggcgttcctgactcaagcatttcagcggcgatcggctatgccgaagcgacgggaattccttacgaactcggattgatcaaaaaccgctatgtcggcagaacgttcattcagccgtcacagtcgctcagggagcagggcgtgagaatgaagctgtcagccgtccgcggggtcgttgaaggaaagcgcgtcgtcatggtggacgattcaatcgtgaggggcacgacgagccgcaggattgtgacgatgctgcgcgaagccggagcgacggaagtgcacgtcagaatcagttccccgcctattgcccatccgtgcttttacggaattgacacatcgacgcacgaagaactgatcgcgtcctctcattcagtggaagaaatccgtcaggaaatcggcgccgatacattgtcattcttgagcattgaaggactcctttccgggatcggaagacagtatgaaggtgaaaactgcggccagtgcatggcctgttttacaggaaaatatccgaccgaaatttatcaggatactgttcttcctcacgtgaaagaaatcgttttgacaaaataaaccggccggcgcgattgaagcgcctggcctgctgaaatgaataaagggcagcagaggcaatgcggctgctcttttgattttgaatatcacgaatggacaagcgcggaataaggagtgattgtgttgtctgaaagctataaaaacgccggggttgatattgaagccggatatgaagccgtaaaacgaatgaaaaaacatgtggaaagaacgaagcgaatcggcgcaatgggcggacttggcgggtttggcggcatgtttgacctgtcggaactgccgtacaaacagccggttctcatttcgggaacggacggtgtcggcacaaaactgaagctcgcttttgcgatggacaagcatgacacgatcggcatcgatgccgtcgcgatgtgtgtcaacgatgtgctcgctcaaggagcggagccgcttttcttcctcgattaccttgcggtcggaaaagccgatcccgtcaaaattgaagagatcgtaaaaggcgtcgcagaaggctgcgtacagtcgggatcagcgcttgtcggcggagaaacggcggaaatgccggggctttatacagaggatgaatacgatatcgccgggttctcggtcggagctgccgaaaaagatggcatcgtcacgggcgaaaatatcagcgaagggcaccttttaattggactatcttcaagcggccttcacagcaacggcttctctctcgttcggaaagttcttcttgaagatgccggtctgaaccttgatgagacgtatgcaccttttgaacggcctcttggcgaagagcttttagagccgacgaaaatctatgtcaagcctgtccttgaagcggtgaaatcaggcaaaatcgccggcatggcgcacgtgaccggcggcggttttatcgaaaacctgccgcgcatgatgcccgatggcctcggcgttgaaatcgacatcggctcctggcccgttcctcctatcttcccgttcattcaggagaaaggcggcctgaaatccgaggaaatgtttaatgttttcaatatgggaatcggctttgttcttgcggtgaaagaagaggatatgacagacgtgatccaaacgctcgaaaacaacggtgaaaaagcctatctcatcggcagagtgaaagccggaagcggcgttgtgtttggcggtgccggtctttcatgaaaaaattcgcggtatttgcatcaggaagcggaacgaattttgaagcaatcgaaagaagaatgagagaagagaactgggatgccgaaattgtcctcgtcgtctgtgacaagcccgatgcgaaagtgcttgaaagggcggaaaaagccggaatcccgtcgttcgccttccagccgaaatcgttcgacaataaagctgcatttgaacaagtgatcgttgaacagctccgccttcacggagcggaatggattgtgctggcggggtatatgaggctgatcggcgatacgcttctttcggcttaccggaataaaatcatcaacatccatccgtcgctcctgccggcgtttcccggcatcgacgcggtcggacaagcgtacagagcaggcgtgaaagtggcaggcatcacggttcactacgttgacgaaggcatggacaccggtccgattatcgcccagcgcgccgttgagcttgaaaaaagcgaaacactcgcgtctcttgaagaaaagatacacaaattggagcatgaactttatcccgaagtaatcaaagagcttcttgaactaaatggcagaggtgaaaaggaatgacgatcaaacgcgcattaatcagcgtatctgataaaacgaacattgtcccttttgtaaaagaattgacagagcttggcgttgaagtgatttcaacagggggcacaagcaaacttcttcaggaaaacggcgttgacgtcatcggcatttctgaagtgacgggctttcccgaaatcatggacggccgtctgaaaacccttcatccgaatattcacggcgggcttcttgccgtacgcggcaacgaaaagcacatggcgcagctgaatgagcagggtatccagccgatcgaccttgtcgttgtcaatttatatccttttaaagaaacggtttctaaagaagatgtcacattcgaagaagcgattgagaatatcgacatcggcggccccggcatgcttcgcgctgcagcgaaaaaccaccaggacgtggcggtcatcgtcgatccccgcgattacagccctgtgctgaacgacttgaaagaaaacggcagcgtctctcttgagaaaaaacgcgagcttgcggcgaaggtgttccgccacacggcagcatatgacgcgttgatcgctgactatttaacaaatgtaaccggtgaaaaagagcctgaacagttcaccgtcacttttgagaaaaaacaatcgctccgctacggcgaaaatccgcatcaggaagcagtcttttatcaaagcgcgctccctgtcaaagggtcgatcgcttcagctgaacagctgcacggaaaagagctttcctacaacaacatcaaagacgcggatgcggcacttcaaattgtccgcgagttcaccgagccggctgcggttgccgtcaagcatatgaacccttgcggcgtcgggacgggcaacacgatcgaagaggcgtttaacaaagcatacgccgctgacgaaacatcgattttcggcggcatcatcgccctgaaccgcgaagtggacaaagcgactgctgaaacgcttcacaaaatctttttggaaatcattatcgcgccggcattcagccaagaagcgcttgatattttaacatccaagaaaaaccttcgcctcttgaccctcgatgtcaatcagcctgtgaaaaacgaaaaacagctgacatctgttcaaggcgggctcttgattcaggatctggatatgcacggctttgacgacgctgacattacgattccgacgaaaagggagccgaccgaacaggaatgggctgacctgaagcttgcttggaaagtcgtgaagcacgtcaaatcgaatgcgattgtcctggcaaaggacgatatgacgatcggcgtcggcgccgggcaaatgaaccgcgtcggctcggcgaaaatcgcaattgagcaagccggggagaaagcaaaaggaagcgcgctcggatcagatgccttctttccgatgcctgatacggtcgaagaagcggctaaagccggtgtgacggcaatcattcagccgggcggctcggttcgtgatgaagattcaattaaaaaagcggatgaatacgggatcgcgatggtgttcaccggaatccgccatttcaaacattaagggagtgaccagcgtgaacgtattgattatcggcagaggcggcagggagcacacgctcgcctggaaagcggcgcaaagccctcttgtcggcactgtatatgcggcgcccggcaatgacggaatggccgggaccgccgtactcgttgatcttgacgaaggcaatcacgaagggcttctcgctttcgcaaaggaaaacaatatcggactgacgatcgtcggtcctgaggtccctttaatcgaagggcttgttgatgcatttgaagaagcgggccttccggtgtttggaccgtcgaaaaatgcagctgtgattgaaggaagcaagcagtttgccaaggatcttatgaaaaaataccagattccgacagcagaatacgaaacgtttacatcttttgaaaacgcaaaggcgtatgttgaggaaaaaggcgctccaatcgttattaaagccgacgggcttgccgccggaaaaggcgtcacagtcgcgatgacagccgaagaagcggttcagtgtctgcatgactttttagaagatgaaaagttcggcgaagcaagcgcatctgtcgtcatcgaggaatttttgagcggtgaagaattttcgctgatggcttttgtcaaaggtgagaaagtgtatccgatggtgattgcacaggatcacaagcgggcatttgacggagacaagggcccgaatacagggggaatgggcgcgtattctccggtgccgcagatttcggatgcggtcgtcgaagacgccgttaaaacgattttggagccggcggccgaagcgatggttaaagaaggccgttcgtttacgggagtcttgtatgccgggttaatgctgaccgaaaaaggaacaaaagtgatcgaattcaacgcgagattcggggatcccgaaacccaggtcgtcctgccgcgtcttgaatcagaccttgtccaggtcttggttgatctcctcgcagacagagaagtggagctgaagtggaaggatacggcggcagtcaccgttgttcttgcatctgacggctatccggaaagctatgaaaaaggcgcgccgatcggcacgcttgagcctgacatggagcagaccgtcgtctttcacgcaggcacgaaaaaaagcggcgatcagtttgtgacgaacggcggccgcgtcgccaatgtcaccgcgtttgcagagacgtttgatgcggcaagggaagcagcctatcaagcggtggatcgagtaagaaaaccggggctgttttaccggatggacatcggctcgcgtgcgctcaaggcagcacagaaataataggtgaagagacagagcgggagcacccgttttgtctctttttttgagctcaatttttttggatgatcttgatcatcgattcagccatcaattcgggcggataaggcatgccgttttcaagccaccatgcggctgtgcccgcgaaggcggaaatcacaaaccgccgctgaatgtcgagaggcactgagcggtcagtatcagcagctgccgtttttttgattcccgtcaaaaagctgtcattccaaaaatcattgagcagctccttaatgttcagctcatatcttctgttgatgataatcgcaaaatcgccgctgttctgttacaaatgatgataaaagcgcagcacataccagtatgcttctggctttttcccgctgctatctatatcaagcggcgaaaaaatatcctctttcatcgcctcaaacatatccctcatatgttgatgaagcaaatcgtatttatcttgataatgctgataaaatgtcgttcgattcaagtttgcccgttgcgtaatatcctgcacagagatttttccccattctttttcagcaagcagttcaaacaaggctttttttaagtttgttttcgattttgtgatccgcttgtccccgcggtagctgtcagccaattcagccgcctcctcaatcactttttcgacacttcttttccatttgttggttgaatggccagatggaatctattaatttaaaactaacatattgaacttcatgaatcagctgacaagcaaccgaaggagtgaaagcgattgagtcaaacaaaacagcagaaccccattcagaaagcgctgattaacggaaagaacagacaagacccgtatgatccgtttccgtggtataaaaaaatgcgcaccgaatcaccgattcactatgatgaagacagcaaagtgtggagtgtgttccgctatgacgatgtcaaaagagtgatcagcgacaaagactttttttcaaatcaattccctcagcttggaactggcaatacgtttgcgaaaacgatgatcagcatggatccgccgaaacacacgagaatcagatcgatcgtcaacaaggcttttacaccgcgcgtcatgaaggagtgggagccgcgcattcgcgaactgacgaatgaattgctcgctgatgtccgcggcagggaagagatcgaccttgtacaggatttttcatatccgttgcccgtaatcgtcatttcggaattgctcggcgttccttcggtgtataagcatcatttcaaagaatggtccgacctgttggtcagcctgccgaagagcgatcggccggaagatgtgaacgagtggaaaaacatcagggaccaaggcgaagaagagctgaccgcattctttgaaaagatgattgaagagaaaagacaaaacctcggcaatgacctgatttcgcttttgatcaaagccgaacaagaaggggacaagctgtcccctgatgaattggttccattttgcaatctgctcttgatggcggggaatgaaacgacgacgaatttagtttcaaatgcggtctacagcaatctcgaaacaccgggcgtgtatgacgagctcgccaggcatcctgaactgattccgcaggcagtcgaggaagccgtccgtttccgggcgccagcgccgatgattgtgcgcttcgttaaacaggataccgagatcagaggagtaagcttgaaaaaaggagaaggtgtgatcgctttccttgcttctgccaaccgtgatgaaacgaaatttgagagggcgcacgaatttgatattcaccgccatccgaacccgcatatcggatttgggcacggcatccacttttgtttgggcgccccgctcgcaaggctggaagcggcgatcgccattgaggcgctcttaaagcagtatgcctcgatggaaaagcttgcggtcgtgccgatggccgacagcagcatgtacggcttgaaacatttccgtctgcgggtgaagtcagcaggggaaacggcgcctaactaattagaaaagcaccgaaaaggtgctttcagcgtgtcgacaaaccctcgcattcgttgtcaggcctgctaagtcggtgctcacgaatagaggaaggatcggcggctaaccgcccaggcgtcctgcctgaacgccgccgtcatcacctcctgtgaaagtccgctccgatgctcggccttcctagactgcaaggttttcaatcacgctgaaaaggtgacgaaatcctaaaactttaaaccgttttaggatttcgtcaacaatctgccaccttctttcccaagaaggtgtttttttacggacagggcatttctttcattgcataagcaggtcagcaggaatttgactggataagcctcgtgctttaaaatgaaagtaataaaaatgaatactccaaaggggagtagctgtcacagtaaagtcgtcattacgggatgtcctagatcctcggctttactggcaatctaattgttagcgagacctttgccaaatctgatttggtgaaggtctttttgtttatccacttcaccaaatcggtggagttttttcatttttatcaaaagggaaaggagactgaccgtgtctaagctcgggaaatggctgaagcgtgaattggtgaagaaaggtctgcctttggcgaaagaaaaattaattccgattttgaaagaaaaaatgaaaaagaaacgataaggaggcaaacaatgaaaagaattcttatagttcttgccggaatgggccttttaggtgcgggcggatgcggaatgcttgatcaggtgaatgacggattgaactatacaaatgaagcggccggctatatccaaaaagtgaagacatttgcggaggaggcgccttccttggctgaacaggctgtaaacgacacgggtgcaaaagaaaagttggaaactcagcttgagtctatccagcaggctgcagccgattttaatgaattaacccctcctgatgccgcagccgaggttcataacaccatcgagaagcataatgaaacactgcaaaaaagcgctgaggatgttttgaaaagtgttgaggaaggaaaattaacagtcgagaagctggagcagtcagaattggtgcaaagcgctcagcagatcagcgatgtgatgggccagattgaaaaattgaccgaatagaaaaaagcatcccggtttgggatgtttcggcttgtcgacaaagtcataaaaagtggcttcatcgacaagcttttttaaaaaaatgtgagtggaatctagattatgttgcccaagcactcaaaagatcagcgtaaacagcttgaagtcgttgccttaagtgaacttgtccctgaagatcaactggtcaggaagatggaagaagccatggatttttcatttatttatgaaaaagttgcccctctttattcttcaaaagcacgtccaagcattgatcccgttgtattgatcaaaatggttctgattcaatacgtgtttgggcatcgctccatgcgcgaaaccatcgaacgggtttttgcggatttaaaacacaagcgtggcctgcgctggacaaccctgcggggaaagaaaaaattgtccatgcaggcgatgcttgttttcgctgccatgaatctaaaaaactggcgaattggacgtggaaaggccctaatcgccagccttttcatcgaaaaaacaaaataaactggacaaaaataggtcggatcttagaaatccgacctattttgtcaacggtctgaaagcacctataaaaggtgctttttatgattgttcgccagtctctccctgttgcttcatatacgtttggcaaacatatgtcatgggacaaaatcgtaaaatgccggaagcggccttcatcgcccccataaacatgcagaaaagcgtcattctgcaccacggttttctcgtaaactttgccgctgccgccgacaggatcgtcagtccgcaggcaatccgaaaaacggcgtcaaacagtccgatgttttgcttcatactttattcctcctatttaaataattaaataaagtgttttttcaaaaaattgtaacggattggtaatgcgtgacgatagtaaatgtgttaacataggatcattacatgtaaaggagagtatgtgaatgtccgaacgcaccttaatttggaaaaacaagcacatcagatcgcaagttgatgttgtaagttcaaggctgcagccaacgctccttttacgaaatgcatctgtactgaacccgtatgtaaagcaatggattccagcaaacgtatggattcatcatgacagaatcgtttatgtcggccgtgacttgccgaagacggctgttaaaactacaatagattgtgaaggaaaatacattgtacccgggtatattgagccgcatgtacatccttttcaaatttataatccccaaactttggccgaatatgtgtcacagtttggaacgaccacattcgtaaatgacaacttgtttctgcttttacattgcggaaaaaagaaagcgttttctatactggaggaactgaaaaaacagcctgtccactactattggtggtcaaggtatgacttgcagaccgaagtgttgaatgaagatcaaatcttatcgatcgattaccgaaaacattggggagaacacccggatgtcatccagggaggagaaatgacaggctggccgcgccttttggacggcgatgatctgatccttcattgcatgcagtgcacgaaaagaaggagaaagcggatcgagggccattttccgggggcatcggaaaaaacgctgacgaagatgaagcttttcggcgctgacgccgatcatgaagccatgactggaaaggaagtgctgaagcggcttgaacttggttaccacgtcggcttgaggcagtcttccatccgccctgattcgcgaaaaattttgcgcgagctgcacgaagaaggctttcaccattatgaccatatgttttatacaacggacggcgcaacgccgaacttttataaagaaggcatgacaaacaagctgattgaaatcgccatcgaagagggcgtgccgctgatcgacgcctataatatggcttcgtttaatatcgcgaagtattaccatatggaggacatccttggggtggttgcaccgggcagatacgcgacgctcaacattttgaatagccctgatgaaccgaatccggagacggttttggcaaaaggtcggctgatcaaatcaggcggcataaatatgaatgcgttttcagttccggattggcaaaaagggggtcttgtccctctgaacctttcatatgatctaacgatggatgatttgcagttttccatgccgctcggcttgaaaatgaggaattccgtcattatggagccttatacgattgagattgacaactctgtgaaccagctttcttttgatcatgatgaaagctatctctcgctgttcgacaaatacggaaagtggcgtgtcaatacgatgctgaaaggctttgcaacccgcatccaaggtttcgtcagctcctattcgacaacgggagacattatcgcgatcggcaaaaacaaggaagacatgcttttggccttcaaacggatgaaagaaatcggaggaggtatcgtattagcggaaaacggaaaaattctgcacgaaattcctcttcatttaagcggcggcgcatcaattgagacgtatgaaaaggtgcttgaaagggaaaaagcgttaaaagagcttctgtttgaaagaggctatacgttcgacgacccgatctacaccctgctctttttgcaaagcacccatctgccttatatcagggtgacgccgaaagggatctttgatgtgatgaaaaaaactgtactctttccatcgataatgcgttaaaatataaaagagcgggagctaatctatggtgaatcgatatgtaagagtactgctttgttttgcttcgcttttactgcttgcatcgtgccagtcgcaggaacagcaggaaaaggaaaagaacattcatccgctgacagggttgaaggcggacggagatattcggcagcggcccattgccgttgtggtgaacaatcattcaaaagcaaggccgcagtcgggattaagcaaggctgacattgtcattgaagctctcagtgaaggaccgatcacacgattgttggcgatctatcaaagcgatatgcctgaagcggttggcccagtccgcagcgcccgggagtatttcattgatttggctctcggttttgacagcatccttgtgcatcacggctggagtccgggggcaaaagaccgcctgttgaacggcgacgccgatcatatcaatggaatggatcacgacgggaccctgttttggagagccgattttcgggaagcgccgcataattcgtacacatcatacaaaaacgtaaagcaagcagcagatgacaaaggatatgccatcgaaacccgcacagaaccgctcacttttaaagcaagccctgataaaccttcggatgcgctttattctatacggttagactatggaacaaaatccgttacaaaccgtgtcgaatatggttatgataaaaaggttgaaggctatgtgagaaagtcagacggcgttttgacaacagaccttgaaacagaagaaccggttgttcttcaaaacattctaatagcggaagccgaacatcatatgaaagatgcgtacgggagaagggatattgaccttcgttcaggcggaaaaggactccttctgcaaaacggggaagtccatcggatcagctggaagaacgaaaacggccggatcataccgacggcggacggcaaaaccgttccgttcgtgccgggaaaaacgtggatcaatatcgttcccgatctcagcaaggtttctattagcaaaggagaaggtgtgtaaagatgcagatcgataaattgcgcgggagagagctggaccagctttttcaatccatactatcactaaaagatctcgaagaatgctatcgttttttcgatgatttatgcacaataaatgaaattcaatcattggctcagcggctcgaagtagccagaatgctgcgcgacggcaacacgtatcataaaattgagacggaaaccggagcgagcaccgcgaccatttccagggtaaagcgctgcctgaactacggaaatgacgcttatatcatggcgctggaccgcgtcaaagcaaatcaatctgaatcatcttcatgatgtcatgaaaccgcctggctcagggcactgagcaccggcggtttttttgtgcttctgcccgtttatcgtttatttgttatccgtttttcgaaaggggctgaatttgttataatatttaaatggtaagaacgcgaatggaggagctttttcatgtacgatattaccgagtggaagcacgtctttaaactcgatccgaataaagatattacggatgatcagcttgaacagctgtgcgaatccggaacagacgcggttttgatcggcggaagcgaccatgtcacagaagatgacgtccttcggctgatgtcaaaggtgcgccgctttttagtgccgtgcgttcttgaagtatcgacgatcgatgcgatcgtcccggggtttgacctctattttattccgactgtgctcaacagcagggatacagactggattgccggcttacataaaaaggcgatgaaagaatacggcgagctgatgtcgccggaagagattgttgttgaagggtactgtattttgaatcaggactgcaaggctgccgctttgacgaacgcagataccgagcttgacattgaggatattaaagcgtacgcccgcgtagctgaacatcttttccgccttccggtcttttatcttgaatacagcggcatgctgggtgattcagagaccgttaaggaaacgaaagccgtgcttcaggaaacgacgctgttttacggcggcggcatcaaagatgcggagacggcggttaaaatggctgaacacgccgatgtgatcgtagtcggaaacgcgatttatgagaacttcgaagaagcgctgaaaacggtacaggccgtaaaaggatgagcacaacgaaccggattggtttataatagaacatatgtttgaataggcggtgaacggaattgaattacattagcgaccaattattaagcggattgaacaagatgcagcaggaagcggtcaaaacgacggacggtccgcttttgatcatggcaggagcaggaagcggaaagacgcgggtattgacgcaccgcattgcgtatttaatggcggagaagcgcgttgccccgtggaacatactggcgattacatttacgaacaaagcggccagagaaatgaaagaacgtgtggaaagcattctcggaccgggagcggatgacatctggatttcgacgttccacagcatgtgcgtcagaattttgcggagagacatcgacagaatcggcatcaaccggaatttctcgattcttgatacgtctgaccagctttccgtcattaaaggaatcctgaaagaaagaaacatcgatccgaaaaaattcgatccgagaagcatactaggatcgatcagcagtgcgaaaaacgagttgatcgccccggaagaatacgagaaaacagccggcggtttttttgaacaagtcgtcagcgatgtctacaaagattatcagaagaaactgcggaaaaaccagtcgctcgattttgacgatttgattatgacgacgattgtcctgtttgaccgggtgccggaagtgcttgaatactaccagcggaaattccaatacattcatgtcgatgagtatcaggatacgaacagggcgcagtatttgctcgtcaaaaaaatggcgcagcgcttccaaaacatctgcgttgtcggggactccgaccagtcgatctacagatggcgcggagcggatatcgccaacatcctgtcgtttgaaaaagactatccgaatgcgagcgtcattctgctcgaacaaaactacagatcgacaaagcggatattgaacgcggccaatgaagtgattcagaacaactcaaacagaaagccgaaaaacctctggaccgaaaatgacgaaggggcgaaaatctcctacttcagaggcgacaacgaatttggcgaaggccaatttgtcgcgggcaaaatcagggagctcgtcggctctggaaaacgatccttctcagatatcgcgattttgtaccggacgaacgcccagtcgcgggtcattgaggaaacgctgatgaaggcgaacatcaactacaacatcgtcggcggcacgaagttctatgacagaaaagaaatcaaggacatcctcgcgtatttgcgcctcgtcgcaaaccctgacgacgatatcagctttgcgcggatcgtgaacgtcccgaagcgcggcgtcggtgcgacttcagtcgataaaatcgcggcctatgccgacatgaacggtatgtctttatttgaagcgctcggccaggttgactttatcggcctcagtgctagagcggccaacgcgcttgatgagttcagacagacgatcgaaaacctgacgaatatgcaggaatacttatccgtcacagagcttacggaagaaatccttgaaaaaaccgaataccgcgaaatgctgaaagcggaaaaatccttggaggcgcagagccgccttgagaatatcgacgaatttctctccgtaacgaaaaactttgagcagcaaagcgaagacaaatcgctcgtcgcttttttgaccgatttggcgctcatcgccgatatcgatcagcttgatcagaaggaagaagagaccggaaatcaagacgcggtcatcttaatgacgcttcatgctgcaaaaggactcgaattcccggtcgtgttcctgatggggcttgaagaaggagtgttcccgcacagccgctccctgatggaggaagcggagatggaagaagagcggagactcgcgtacgtcggcatcacgagggctgaggaagaactttatttaacgaacgcgcggatgcggacgttgttcggaagaacgaatatgaacccggaatcaaggttcattgcggaaataccggaggaattattggacaatctaaacgagaagaaaaaagatctgaaaacgccgtttggaagaaagcccgagcggagaggccccgttacccgtccggctgcatcgtacagcaaaaccggcggcgacggcgtcaattgggcagtcggcgacaaagcctcccataaaaaatggggcgtcggaaccgttgtcagcgtcaagggatccggcgaatcgacagagcttgacatcgcctttccgagcccgaccggagtgaagcgtcttctcgcggcctttgcgccaattgaaaagcaataatggcaaaagacctgaaatgaaaggacgaaaccaatggaaaaagaagcagctaaacgccgtgtggaacaactgcatgcattgattaacaaatacaactacgaatatcacacccttgacgatccaagcgtgcctgattccgaatatgacaagctgatgaaagagctgattgctcttgaagaagagcatcccgacctgaaaacgccggactctccttctcagcgcgtcggcggagccgttttggacgcctttcaaaaagtgcagcacaaaacgccgatgctgagcctcggcaacgcgtttaatgaagaagatctgcgcgactttgaccgccgcgtccgccaggcggtcggagacgttgaatacaacgtcgagtttaaaatagacggtcttgctgtttcactgcgctatgaaaacggcgtatttgtcagaggtgcgacgagaggcgacggtacgacgggcgaggatattacggaaaatttgaaaaccatcagaaacattcccctcagaatgaaacgcgatctttctattgaagtgcgcggcgaagcttttatgccgaagcgctcctttgaactgctgaacaaagcgcggatcgaacgtgatgaagagccgttcgccaacccgcggaacgccgctgccggttcattaaggcagctcgatccgaaaattgccgcgaaacgaaatctcgatatcttcgtctacagtatagcggagcttgatgaaatgggcgttgaaacgcaaagccagggactcgatttcctcgacgaactcggcttcaaaaccaatcatgaaagaaaaaaatgcagcacgatcgaagaagtcattgagattgtcgaagagctcaagacaaaacgcgccgacctcccgtatgaaatcgacgggatcgtcattaaagtcgattcccttgaccagcaggaagagctcggctttacggcgaaaagcccgcgctgggcgatcgcctacaagtttcctgccgaagaggttgttacgacgcttttggacattgaattaagcgtcggccggacgggcgcagtgaccccgactgcgattctcgaacctgtaaaagtggcgggaacgaccgtccaaagagcttctctccacaacgaagatttaattaaagagaaggatatcagactgctggacaaagtcgtcgtcaaaaaggcgggagacatcattccggaggtcgtcaacgtcctcgtcgaacagcggacgggcaaagaaaaagaattcaacatgccgaaggaatgcccggaatgcggaagcgagcttgtcagaatcgaaggagaagtcgcgcttcgctgcattaatccggaatgtccggctcagatcagggaaggcctgatccattttgtttcccggaatgcgatgaatatagatggtctcggcgagcgcgtcatcacccagctgttccgcgaagacctcgtccataatgtcgccgatctgtataagctgacgcgcgagcagctgatcaatctcgagcggatgggggaaaagtcgaccgacaacttattgaattcgattgaaaaatcgaagaagaactcattggaacggcttctcttcggactcggcatccgcttcatcggcgccaaagcggccaagacgctggcgatgcattttgaaacgctcgataagcttaaaaaagcgacaaaagaagaattgatcgaagtcgatgaaatcggcgacaagatggcggacgccctcgtcacctattttgaaaaagaagagattctgaagctgttggacgagcttgaagaactcggggtcaacaccgtgtataaaggcccgaaaaaagcggccgctgaagcgagcgattcgtattttgcggggaaaacgatcgtcctgaccgggaagctcagcgagatgtcgcggaatgacgcgaaagcggaaatcgaagcgctcggcggaaaaatcacaggcagtgtaagcaaaaaaaccgatctcgtcattgccggcgaagcggcaggcagcaaactggcgaaagctgaagacctaaacatcgaagtatgggatgaggcaagactgatcagtgagctaaagaaataagaggagtgttttctattgaaaaagatattatgtttggcggctgctgcgggtatgctcatgctctcagcctgtgcgccgaattttgggggagaagaagagcaggagatggtgcagaaaacggataagtcgaaagaaaaagccatcattccgaaatacaacatctccgattcttattataaaatggttcttcctttcaaggcggggaaagcccgcggcttgacgaccgaacgcctgaatacgcggctggatatcgatgaatttgagacaggcatgatgcgccttgcgcaagattcattttctactgacgattacctttttcaagaaggacaatacctggatgaggatacggtatcgagctggctcgcccgcaaaaaaacgggggacgacttgaaaaaagcggagaaagacgataaaaacttcaaaaacctcggactgaacccggccctttccggaagcggatcaacagagaagcaaaacgaagaaagcccgatatacctcgcccatatgcttgagcacgactacctcatccgcaaagacaaggatacgattgagctcggaggcgtcgtgatcggccttgcgctgaactctgtccactactaccgcgaaaatgtcggcgacccgcaaaaagaagtgaccatcagcgacaaaaagctgaggcaggaaggcgaaaaaatcgctgaagaagtggcgaaacggatcagaaacatggatgatctaaaaaatattccgctgacgatcatgctttacaagcaggcgcctaagtcatcgatcgtccctggaaactttatcgccaaaaccgatgtgaaagcagggacaagcgagatcggcggctgggataaaatcaatgaagagtacacgttcttcccttcaacagaaggttcggagaagcatccggatgacgcggagctcttcaaacgctttaaaaacaaagtcgatacgtattttccaaactacacaggggttgtcggcacggctctctataaagacgaccaaatgcaggacatgaaaatcaacatcccgatgcagttttacggcaaaagcgaagtcatcgcctttacccagttcttgaccggtgaagtgatggactactacggcaaaagcggactgaacgttgagatcaacattaattcgtcagccgggcaggaagccgtcattctgaaaaagccgggagacaaagaaccgaccgtccatatttatgattcataaaaaagaagcagccctttggctgcttcttttattacgcagaaaagggatatggagacctatcattcatttatgaagcaccaacaaatttttcttaacgtattctgaataaaatactattgcaaaattaggacacaactcttataattgattatacagaatatagtatattgttttaaggaagattaattatgtgggaaaaattttactctaaaaatggtttggcagctaaaaatattgctaaagaattgatgaatatcaaagcaggtgaaaaaattccccgtatctcagactactgtcataagttatccatcggcagggggactgtgcaaagtgcgctgaatttattagttgatatgaaagcgattcaattggaggctagagggcatttaggaacgtttttggtaagtaaggataacaatttattacttgagattgcaggtattgcaccattaatcggctcaatgccacttccgtattcaagaaaatatgagggtctggcaacagggattgtggaagggtttgaatcaaccggaaaaacagttaacttgatctacatgcgtggcggagtgaatcgaatcgaagcagtccgaacaaaaagaagtgattttgcaattgtttctaagatgacggcagatcatattatagcagaatatccaaatttgaaaattttcaaaaaattcggggaaagtagttatgtatcttcccataaaatcttcttagctcatccagatgaggaaataggcaaggatggcgtaagagtaggtgttgatttggaatctctagatcagaaacaattaacattggctgaatttgaaaacaaaaatgctgaatttgtcaatgtgaattatatgcagctctttgatatgcttctttcaaaacaaattgatgcagcagtttggaatgctgatgacaaaagaatgattcaaacgtttaaagcaatcgattttttttcaccgaaagcaaagaaaatttccaaggatacaacagaagccgttattgttattgaaggagacagagaaaaagaaatagcagaaaagtggaatttggttaatgagaaacagatattagacacccaaaaaagcgtagaaaagggagagaaaataccgcgctactaaaatgccggcccatccgacttgtcattcaataaatgaggcgatgggttagcatttaaaatctaatttaaaatactaaatacagtatattggaggaactggcgtgaatcaaatacagctggaagaaaagttgtctattttactaacgagtcgagtgattacaaaaaatgctttcaacacaacattgaacacatttgttttcttatcagaaaagctgaaaaaggaggtgatcaaagactctgaaatgttttggacgcacatggcgatggctttaactagaattaaggagggagaaagcgaagaagttcctgcaaatgccatcatcaatgaaatgtatgaaacaccatataaaagtgcaatagaagaagtgatagactttatacattcactggcaggtctagaacttccagaaggtgagctcgtttatttttatcttcatcttcataaagtcatagaatctaataaataggaggattttattatggtgagaattgtaataggcggacagttgaaaaaacaagcgattgaaaaacttgttaaagaaattgggggaaataatgtagaagtattggtcaaaggtgatttggacgctgttatggctgtgaaaaacaataaggcagattattatattggcgcctgtgaaaccggatctggcggtgctcttgcaatggcaattgcattattaggtaaagataaatgcgtcaccttggcttctccaagtaccataaaaaacaaggaagagatcgagaaggaagtagaaagcggcaaaattgcttttggtttcaccgcttcaacatcacaaaatatattaaacattttaattccttatttattaaaataagcgaacttttccaatatatattttgttatacaggcttaaatttttttcagttaaggaaagcgctttcttggatgctcgaaataaaagaagcgtggatgacatgatgtacagaaggtgagaaaaatcatagaggtgaataatgtaatggacctttctttgattcaatgtcttgtcatagcggctgttggtgcattaggttctatactagtcaatcgcggggtagctgtatttaatgatggtttgcgtccgattatgcccgaatacctagaggggagaatgacaagaggggagcttgctgcaacaagctttgcattaagttttggattaatcatagggtttggtattccgctttccataggagcaacaatcattattggacacagtattttattggcttgtgacatcattggcatttggactccggaaaacaaaataggcatggcaactgcaggagttattggtgccgtttatagtattgggatcgttttaggattgcaatttgtagtagatttatttggcaagtttcccgtgaattttatagactctttaagtcttattggccagcctattattatcgcatttacagtatttccagctgtagcggtcggatatcagcacggtttaaaaaaagccgccgtcactgcaattgtaactttagcttcttttctcttattcgaaaagtttggaacatttcaagcggcgggatatgaaatttcgctcagtcctgaagggatggctttattagcaggaatgttaatgatgatttattatgcagcgagaattagaggaggagatgaatctactaatgcaaatttagtgaatatatttaatgagcgtgtaaatcgaattaagaaaaaccgctggttattagctcttatgggagggcttgtttctttaacatcatctatgctgattttagcagtggatgcaatgcctcaagcattgattaataaagagctttacacagaggcggcaatcgctacatttgcacgtggaattggtttcatccctttagttttttcaactgcaatcgtaacgggggtttatggtttagctggtaccacactggtatttgcagtgggtcttattttcagggatataccgattttagcatttctgttgggctttttagtcatgtatttagaggtcatatcattatccgcagtatcaaaaagcatggacaaactgcctggtgtaagggagatgggagagcatatccgcacttcgctgtcagatgttctaggaatggctatattaattggcagtgcgatggcaggggaaaaaattgctcctggcattggcttcttctgggttattggattttatttaataaaccgaatagcatcaaaaccgcttgttgaattggctgtcggcccaattgcagttatattgttggggattgtcgctaatcttctctatgcagtcggtttatggcaggttggctaaatcatcgaaagaggggaagtttccgaatgttgaaagacggaatgacctatatgcatgaacatacaacgatagacctttccaaagtaaaaaacaatgaggattgtaagttggatgtatttcctgaaaccgtcagagaatttaaaagtttatacgaaaagggcgtacggaatattgttgatgttacgaatattggaatggggagaaatattacatacgtccaaaaagttgcaaaagaaacaggcattaatattgtcttttcaactggtttctatcaagattctttttacccgatccatgtgtttcgtgaatcgaaagaaaagctggcagaaagaatgattatggagattgttgaaggaattagaggaacagatgccaatgccgaggtcatcggtgaaattggaacaagttacaataaatggacggaaaccgaacaaaaagtttttgaagcggttgttgtggcacataagcaaacaaaaaaaccaatatcaacccatacttccataggaacattaggacatgaacaagtagaattttttaaaaaacatgaagttgatttaaaccgagtggtgatagggcatgttgatttatctggggatgccgattatatattgaaaatgctgagagaaggtgtatatgtagaattcgatacaataggtaaagaaaattatatgcctgatcgtgttcgggccgaaatattgaaaaaaatacaggataaagggtatatagacaaggttctgttgtccatggatatcacaagaaaatcacatcttgtatataaaggcggggtgggctattcatatttgatagacacgtttatccctctcttgcaaacctatggaataactggtgaatcaattgataagatgttgattaaaaatcctcgcgcttttatgaaaggggagagtgaatgagcatggatacttatcctctagatagcctatcaattgaagaagccatgcatagacaatttaaattggttgatgtcatgacaagacattttcgaggagaagaattgctttcacttggcgatttaggcgttgtaaaaggaatcaataaaccgcggttcacaaaaaaaatagaagagacactagctgatttctttggcacagagaaagcaatgttagttcgtggtgcaggaacaggggcattgaggtttggttttatgagctttttaaagccgggtgacgagatccttgtccatgatgcaccgatatatccaacaagtaaaacaacgttagagtcgatggggatcttgccaatatacgcggattttcacgattctgaacaaataaaagaagccatcctcaaacacccgaagttaaaaggtgtattgattcagcatacgaggcaaaaaatagatgaccattatgatttggctgaaacgataaaaaaaatacgttccatttattctgatctagttattattacggatgacaactatgctgcgatgaaagcagaaaagattggagcgcaactcaaagccgatttgtccaccttttcattgttcaagctattaggtccggaaggtattggagtcattttaggaagaaaaaatttaatagaaaaaatagaaaaaataaactattcaggcggaagccaagttcaaggttatgaagctttagaagctttaaggggtctgatatatgctccggttatgctggcaatacaagcaagtgtcaatgatcagttagttcactcgcttaataatggagccattaagggtgttaaaaaggcttatttggcaaatgcacaatcaaaagtcttacttgtagagtttgttaaaccaattgcagaaaaagtgcttcatcatgctaatgaattgggagcagcaccccatccgataggtgctgaatcaaaatacgagtttgcaccaatgttttatagagtgtctggcacttttttatctgcggatccatcactggcaaaaaaaatgatccgcattaatccattaagaagcggtcctgagaccattttaagaattctaaacacatccgttcatcgagcaacagaagatctcagcgtaaattcttcaaaaggcgatgatataaatgaataaaagagtcattatcataatattagacagcttaggtgtcggttatatggaagatgcaagcgattatcatccttcagatgttggcgccaatactttctatcacatacttgatacggtgccctctttaaacattccgaatctcgaaaaattgggtattaataaaatattgcaccatcctaaattgaaaaaaacagatcatattgccagctatggtgttttaaacctgatgcatcaaggagcggacagttttgaaggacataatgaaatcatgggaacaaagcctaaaaagacatatttagctccttttgcggaacatatcaatcatgttaaactcgctttggaagatcaaggttataaagttaacataccgaattcagatttgccgtatctattggtaaacgatttagtggtcgtggctgataatatcgaaacagattacgggcaaatttataatgtaagcgctccgctggattatattccgtttgatgaagtattgaaaataggaagatgcgtccgtcatcatgttaaagtaaatcgcgtgattgttcttggaggagaaaacgtaacacctgaacacttgcagagatcggttgaaagaagagaagacggattaataggggtgaattcgcctaaatctaacgtatacaagcaaggatatcaagttcgtcacttaggatttggtatctctcccgaaaatcagttgccgacattggcgagaaataggggaatggaagtctctcttatcggaaaaatgcaggacatcatttattgtgaaggtgcaaatagatttccaggtgtagatacagaacaagtcatgaaggatattattcaggagatggaccgcgtcaaaaaaggcttgattgctgccacagtacaagaaaccgatttggccggacatgcacagaatcccgtccgttatgcgaatcggattgaaatggtagatcgatatttgccggaaattctccggaaaatgacagatcaggatctgctgatgattagtgcagatcacgggaatgatcccacgatcggccacaaccaacacacacgggaaaaaacatatttgctggcttatcacaaaaaattatcgcccgttcacatcggggaaagaaaaacgctatccgacattgctgcaacttctgctgattatctagggcttcgcaatactgaaaacggcagttcattccttcatttaatgcaaaaaggaaaagaggagacatactgatgtttttggaatctacattaaaatataacaaaaaattaatagaggctgcattgagttttcatcagcagggaatcatttcacctaacacttatgtattagacttggacaccgtcaaaaaaaatgcaaaagtgttaagtgaaaaagccagaaaacaggatattgaactgttttttatgacaaagcaatttggccgtaatccgttggtggcacaagctatagccgaaagcggaatcggcaaagcggttgctgtagacccgtgggaagcaatcacactcagccaaaatggaatcaaaattgggcatgtcggacatcttgttcaaatacctattcatatgatacccgcaatattggagcttcatcctgattatgttacggttttcagccttgaaaatgctcaaaacattagtagagtcgctaagaaaatgggaagaaaacaaaaagtttttttgcgtatcgcaaacaaagaggattatatatataaaggtcaagagggagggttcacttttgagcaaatcgttaaggatatcgaatcgattgaacaattagaaggacttgaaattgcaggtttaacaagctttccttgcatattgatccaagacggccttccagcagttactccgaatgtagcatccatgcaaaccgtaaaatcgtttttaatggaaagagggtataaaaagcttgagatgaatatgccaagtgcaacatcttgtgcaacaatgaaattgttaaaggaaaatggtgcaactcaaggcgaacccggccatgctttaattggaacgacacccatacatgcaacgaaacaacttgcagaaaggcctgcgatggtatatgtaaccgaagtgtcccacatatctaatcatcatgcttatgttttcggcggcggtttctatccgcgttcacatatgaaagcggcgctcgttggaacaaacaaagatcatcttaagaaggttcaagctattgaaatgacgcctgatcatattgattattacggttcattaaacacagttgaagcaaaagtcggcgatacggcaatatttgcttttcgtacacaagtctttgtcacgaatgcacatatagccatcttaaaaaacgttgctgaagatcctgaacttatcggtgtatatgattctaaaggaaatgtaatcgagtgaatgatcgttatcggcagaagtgcctgaataatggattgtcttactgaaaaaggtgtggcgaaaatgcttggcctttttgcagtgcagtttaatacagtagtcagtcttggacattttattttgtggaaaggagaaaaacgtgaaaattattcatgtatcaggttatgaagaaatgagtggaaaatcggctgatctaatggctgagctcattcaaaattcaaataatcctgttatcggctttgcaacaggttcgacaccgattggtttatataaatgcctgataaaaaagtatcggcaaaaggaaatttcatttaggaatgttactgcttttaatttagacgagtacgttggattggctaaagaaaataaaaacagctaccattattatatgaatgaaaaattattcaaacatctggatattagtcgaaggaatatcaatatccccaatgggatggcggaagatttggaacaagaatgcctcagctacgacagacttgtttctgaaaaagcaattgacatacaaatattaggaatgggattgaatggtcatatcggttttaatgaaccggggacaagctttaaaagcagaacccatatcgttgatttggatcaatcaacccggcaggcaaattcccggttctttcgttccttggacgaagtaccgacaaaggcattaacaatgggcattgaaacaataatggaaagtaagcggatccttctgctcgtgtctggaaatgaaaaatctgaagccttggcacggctgctgaacagcacccgtgtctcccaagagttccctgcttcaattttaaggaaacataaagatgtgacggtgatggcagatgacgcagccttaaataaaattcattaaattgaatgactgacaaaatcggttaattacattgaaaatttacacaaggcattgctttgaggtatcttctagccatcaatcagccaaaaaacgactgaatatagcaaatttccatcttgttgataaggacttacatatacaggttttgattgtcctcatattgtttactcgaacagttgaaaaggagagaagagtggataatcaattctaggcgagaggaagccatcatcctcaagaaccgaccgttcatattgatgattcataaaagaaaaagcagcctttttttcggctgcttcttttgaatcaagcttgcgtttacagcgtatcacatttaactccgacaacgccgtcgatcgctttgatatcgtaatagacatcggtgacataccttttcttatgaaccatgattttcgtttccatgatcggaaattcattatcgcgcatatcatcgatccggacggaatgaatccggatttttttcgctttcatttcctttaagatatccgtcagtttatccttgtcattcagggacatgcggacgcggatttctttttcctgcaagcggttgggcccgattttgccgacgatccacggcaaaaactcgacgctgattaaaatgaaaatcagactgacaaacgcttctttataaaagcccgctccgatggcgacgccgaggccggccgctccccagatcatcgctgaagtggtcaggccggaaatgacgtcgttgcttttgcgtaaaatcacgcccgctccgatgaagccgatccccgatatgatttgtgcgggaagccgcaaagggtccatcatgattctgttcgaccttggaaaatggtatgccgcatcaatgctgatcattgtcagaacacaggaactgatcgcaatcacgatgcacgtttttaagccgagcggcttgtttttcagctccctttcgagaccgatgaccattccgattaatgttgcgattccaagctttaacagcgtttcagtttcaatatgccaatccatgcccatgatctcctttccgacaatatcttatatgattgatatgattttctcacagacgccctggatggacaactgtttttgaagtgccgggggatgtcctggaaccattcatctgcaagaagcctatactcctatcattatattgccggcgtggcatcaaaagaattccgtctgagcaaaaaagccgccggatatcgcccggcggctttcgtaacctgatcatttaagaatgttcttcctcatgcgtctgttccatttcttcaaacatatctcttgcctcttttgccggtttgttcgtgatcatgctgacagcgtaaacgacaatcaagctcaggaagaaaccagggatcatttcatagatacccgtcttctcctgcaggccggtcagaatccaaatcagcacggtcacggcccctgtaatcatcccggccaatgcgccccactggttcatccgcttccagtacaagctgagaaggatggcgggtccgaatgcagaaccaaacccggcccacgcatagccgaccagatcaaggatcgtgttattcggtgtcagagacagaaggatcgcgatgacggcgacaagcagaacgctcagacgtccgacaagaacgagttccttatccgaagctttgcgccggaaaaacgtccggtaaaaatcttccgtcatggcgcttgatgtaacaagcagctgggaagacaccgtactcataatcgccgcgagcaaagcggaaagcaaaaatccggtgatgagcggatggaataatacctttgaaaacacgataaaaatcgtttccggatctttaagcgctgtacccgtctcatggacatacgccacaccggtcagtccgacgagcagagcgccgattacggagatgatcatccagcccatcgcgatgcggcgcgcaggcttcagttcttttacggatgaaatcgccataaagcggacgataatatgcggctgaccgaaatagcccagtccccaggcgagaaatgaaataatgctaatgacggtcgttcctttgaagaaatcgagcaagcttggattgatttcttcgatcacattgaaagtcggcgtaattccgcctaattgagtaaaggcaacgatcggcacgagcactaaagcgataaacataatcaaaccttgcacgaagtctgtcagactgacggccaaaaatcctccgaacagcgtataggcaattacgactgcggccgttaagaaaagaccgattttataatcgaggccaaacgccgtttcaaacagtcttcctccggacaccatacccgccgacgtgtacaatgtgaaaaacaccatgatgacgatggctgatgccaggcgcaagattcttgttgtatcattaaaccgattttcgaaaaagtccggaattgtaatcgcatcgtttgctacttctgtatatgtgcgcagccggggagcgaccaccaaatagttcacataagctccgattgttaaaccgacggcaagccaggcgcttgaaagtcctgtcacatacatggctccgggcagtcccatcagcatccagccgctcatgtcagacgcgccggccgataaagccgtaacagcaggcccaagacctctgccgccaagcatgtagtcattcaaattggatgtctttctataggagtaccagccgattaagagcatcgcggcaaaataaatccccaacgaaataaatacttcaacactcacgtttcatatctctcctctttaaaaataatgtggcatcacctctttaaaattttcaacaatactgatttgcgggtacgaagaaaattgcagggcctcctctataaaagatcaagtattggaattaaggcgctgcctagatcgtacttagttacctaacctatcaaactattcccaatcaatcaaccgtgaaaaacatccgattttattgaaaaagggcgtgatggttttgatgagcatcatgatgaaagcgtttacaaatgatatacaaagtaaaaatattctgaatattagtacgtgccgttttactgaatttttcatgtacaatgaaataaaaggcgccaaatggggcgaagatcgcggttttgttgatttagaaggctaaaatttgatatgatcagtattatatgactaagcgagaataaccttggaggtgtttttagtatgtcgcgtatttctatagaagaagtaaagcatgtcgcccatcttgccagactggcgattacggacgaggaagcggcgatgtttaccgaacagcttgacagcattatttcatttgcagaagagctgaacgaagtcgatacagagaatgttaaaccaacaacgcacgtattgcaaatgaagaatatcatgagggaagatgtacctgataaagggcttccggttgaagacgtcgtcaaaaatgcgcctgatcataaagacggctacatccgcgtgccgtcaatcttggactaataaaggagggagcgagaaaacatgtcactgtttgaccataaaatatctgaattaaaacgtctcatacataataaagagatcagcatatcagatttagtcgatgaatcttacaaacggattcacgaagttgacggaaaggtacaagcctttttgcagcttgatgaagaaaaagcccgcgcatatgccaaagaattggacgaagcgcttgatacccgggatgagcacggtcttcttttcgggatgccgatcggcattaaggacaatatcgtaacaaaagatctgcggacaacgtgcgcaagcaaaattctcgagaattttgatccgatctatgatgcaaccgttgttgagcgtcttcatgaagctgaagcggttaccatcggaaagctgaatatggatgaattcgcgatgggctcttccacagagaactcaggctttaaaaagacaaaaaacccgtggaacctcgaaactgttcctggcggatcaagcggaggctcagcggctgcggttgcggccggggaagtgccgttttcacttggatctgacacgggcggatcgattcgccagccggcatctttctgcggcgtcgtcggcttaaagcctacatacggacgcgtttccagatacggccttgtcgcatttgcatcttcattggatcaaatcggcccgatcacaagatctgtcgaagacaacgcctaccttctgcaggcgatttcaggcgttgacaaaatggattcaacgagcgccaatgtggacgtgcctgactacctgtctgcgctgacaggcgatattaaaggcttaaaaatcgccgttccgaaagaatatctcggcgaaggggtaagcgaagaagcgaagcagtccgtgcttgaagcgctgaaagtgctcgaaagccttggcgcgacatgggaagaggtatcgcttccgcacagcaaatacgcgctggcgacttactacctgctttcttcatctgaagcgtcggcaaacttggcgcgcttcgacggcatccgctacggctaccgcacggacaatgccgacaacctgatcgacctgtacaaacagacgcgttccgaaggattcggaaacgaagtcaaacgccgcatcatgctcggtacgtttgctctgagctccggctattacgacgcatactataaaaaagcgcagaaagtcagaacgctgatcaaaaaggactttgaagacgtatttgcaaactatgacgtcatcatcggaccgacaacgccgacgccggcatttaaaatcggcgaaaaaacgagcgatccgctgaccatgtacgccaacgacatcctgacgattcctgtcaaccttgcgggcgttccgggaatcagcgtaccgtgcggatttgcgaacggcttgccgctcggcctgcaaatcatcggcaaacactttgacgaaagcacagtataccgcgtcgcccacgcattcgaacaggcgacagaccaccataaagcaaaacctgaactgtaaggggtgaaaaaacatgaactttgaaacggtaatcggacttgaagtccacgtggagctcaaaacaaaatcgaaaattttctccagttctccaacgccattcggcgcggcggccaacacgcagacaagcgttatcgacttaggctatccaggtgtactgcctgtgttgaacaaagaagccgtcaatttcgcgatgaaagccgcaatggcgctcaactgcgaaattgcgacagatacgaaattcgaccggaaaaactatttctaccccgacaacccgaaagcttatcaaatttcacaatttgataaaccgatcggcgaaaacggctggatcgaaatcgaagtcggcggaaaaacgaagcgcatcggcattacccgccttcatttggaagaggatgcgggaaaactgacgcatacaggcgacggctactcccttgtcgactataaccgccagggaacaccgctcgttgaaatcgtctccgagcccgatatcagaacgcctgaagaagcttacgcctaccttgaaaaactgaaatcaatcattcagtatacaggcgtgtccgattgtaagatggaagaggggtcgctccgctgcgacgccaacatctcgctccgtccgatcggacaagaggagttcggtacaaagacagagctgaaaaacctgaactcattcgcctttgttcaaaaaggccttgagcacgaagaaaaacgccaggcgcaggttcttttgtcaggcggtgtcattcagcaggagacgcgccgctatgatgaagcgtccaaaacgacgattttgatgagggtcaaagagggatctgacgactaccgctacttccctgagcctgatcttgtcgagctttacatagacgacgagtggaagcaacgcgtgaaagacagcattcctgagcttccggacgagcgccgcaagcgctacatcgaagagcttggcctccctgcctatgacgcgaaagtgctgactttgacaaaagaaatgtccgacttcttcgaagcggccgttgaaaaaggcgcagacgcgaagctggcgtcgaactggctgatgggtgaagtatcggcttacttgaacgcccagcaaaaagagcttgcggatgtcgaactcacacctgaaggccttgccggattggtcaagctgatcgaaaaaggaacgatttcatcgaaaatcgcgaaaaaggtcttcaaagaattgattgaaaaaggcggagacgcagaaaaaatcgtcaaagaaaaaggccttgtgcaaatctctgacgaagcgacgctcagaaagcttgtcacagaagcgctcgacaacaatccgcaatcaatcgaagactttaaaaacggaaaagaccgcgcgatcggcttccttgtcggccaaatcatgaaagcctcaaaaggacaagcgaacccgccgatggtcaacaagcttcttcttgaagaaatcaataaacgataaaaaacagactatgcctaattaaatggaggtcctcatgttgaggaccttttttatttgtatgaaaatacaaatgaaaaaacttctttctgttcaataatattaaaatttatttgaattttatttaataatatattatcatttatttgaattttgtttttaaatttgttaataagaggggctgtctatggaaagaaaggatgtacccgagtggatcttagctttagaagaagaagatgtagaatttattaaaaactttatgctgaaatctggatctttaaaagaaattgcaaagagttatcaagtatcttatccaacagtcagggttagattggatcgattaattcaaaaaattcaactaattgacgagttagaaaatgagacttttgttaactttataaaacagttagctatcgatgatcagattagtctggaaaatgcaaagctaatcattgagaaatacaaaaaagagcggggtgttcataaatgaatcctatttatatactactcattggctttacaatactagggattcaatattttttatcgaccagaaatcataccttttggggagctatactgcctacagcttatatcgtttttctcgtggcattatccatttatgaaggaaaatctttcgcatcattctttcttcctcttatcggcggattggctttattgttgggagaatggattaaaggcagagaagctttgaaaaaaaagcgggaaagagaaatgagaataatgaaagccatggatattaaataacaggatcagcctcaaaaggacagaacaagctgtttcaaaaaaaccttggagaatgactctccaaggttttttcattattccacgacaggcgtcaaagaatcgccgtcccatatctctcctttattcagcgtccatggatgaagatagagggtgtccgctcccttattcacagccgggctccactcatcgttccacgccaggaagtacgtcgttttcgggtatttttctttgatggcatggataaaccgcgcgtaatccagcccgccgtttgtcgtctgcggtccgacttctgtaaaggcaaacggcttgttcagcgatgtgagctcttcgtagccatcaatggcgtacgggtcatcaaaataagcgtcaagcccgacaatgtccacatatgatgcgcccggataaaagtccgttttaaagtctctgttggcgtccggcgcatacacccacaagagatgatccaggcctcttgtttttgtcatatagtcatagattttcacatagagctgtttgtacaaggagattctttcgctgtctttttgattatattgcgtcagcccccaccagaaccattcgccgttcatttcgtgaaggggtctgaatagaacgggcacgccttcattttcaagctcctggaggccgtccgcgattttgctcagcatcgcctcaagccgctttccttcaggagtggaagaatctaaaattctctcatactggctgtttgaaatctgagttttataatgacccgaagtaaacgcggggtttgcgaggtgcatgctgatttgcggaatgcctccgcttttccagtatgcgatcaaatcacggttgcagctgtagtcaatcgtatcggcgatcttttccggctccagccatcctcttgcataatcgcagccgtatatggccggcagctgtcctgttgcctgtttgatccggtcggcttcagccgttgaaaatgtgtcgaggctgtatcctccgaacgccccggacatcacccggctttccgtccgattgggcaggtgggcgagccagttcatcaccgctttcgtcgtcggctgggcattcgggttcaccggagaaacggtgtgtgcatagctcggctgcgaaacggcaaaagcaaggagcagcgcgaagattgaacaaacgatgttttttttcactaaggtaaaaccccctgaaacatatagattgtcttaagcgatcttattatacatgctgcttccaaaaaatacatggtcagatcgtcttattgtaagggaataaaaaaacagccataaggctgctttatgaatgaaggaaacgggtgatcattccatatagatgctgaacattgtcctgatgctgcaagtttgtcagcatgccttggagcacgggtgcgcggggcgaatcctttctcagctcttcctcgatcacatccagtgtaatgagaatgtcttccgaaagctccggctgacgtttggcatcttcaagctcccgcaaaatcgtatgtttatcggccgtattgccggcgttccggtaatagctgtacgtccggccggccaagatcggctgctccccgttttgaaccatgccatcaatcatgtcatcgattcttctcataataaaatccgcaagttcgtaaaaatcgatatccagttcattaaagataaacaaattttgataagactgcacgatgccttgaacgatcacggacaagtctgacagataaggcttcacaatgtcaccgtaggcggctgacagcgcgttttgatacgtctcgtggaatttttggctgacatttttaaaatattcttcgatcttgctgttttccggtatgctgtgttcgctgatcatcacgagaataaaatcgcggtgctccttgctctcgctgaattgataagcaatctgctccttgaacgtttccttaggagggaaattcttctgctgaatgatcttcatattttccatcattcgatcgatataatacttaatgattgcgagcaaaagagcttctttcgacttgaaatgcaggtagaaagccccttttgagatgttgcattcattggcgatgtcttgaatcgttgtggaagcaaaaccgtttttcgcgaacaggtgcaggcctgctttaatgattttttcttctttttctgtcatgaatgtacccctttaacacttctttaaaattgaataaattttaacatatataagttgacgctgtttacttttgaagtttattattgtatagaatgaccagtcagtcaatctgtattctgaaaatgatacacaatggaggtcgtaatgaattctatcattaattttgtactaaagaacaagttcgctgtgtggctgatgacgattattgttacggttgccggcatttatgcgggtttaaatatgaagcaggaatcgattcctgatgtgaacatgccttatttgaccatcagcacgacatatcccggagccactccgagccaggtagctgatgaagtcacaaagccggttgaacaagccgtgcaaaatctggacggcgtcagcgttgtgacgtccacatcgtatgaaaacgcatcatcggtgatgattgaatacgattatgaaaaggatatggacaaagcgaagacggaagccgctgaagcattggcgaatctcgatctgccggacaatgcgaaagagccgagcatttcgcgctacagcatgaattccttcccgattctcgcgctcagcgtgtccagtgataaagacgatcttcaaagcttgacgaaaaaagtggaagacagcctcctgacgaagcttgaaggccttgaaggcgtagcttccgttcagctttccggtcagcaggttgaagaagtcgaattttcatttaaaaaagacaaattgaagcaatacgggcttgacgaggatacagtcaagcaagtgattcaaggatctgatgtgacgactccgcttgggttgtacacattcggcaaagaagaaaaatcggtcgtcgtcagcggcgatatcgacacaattaaagacttgaaaaatatgagaattccagcggcgtctgccggaggcgcaagcgcgcaagccggagcgcaaagtgcgcaggcggcccagggggcgcaggctcaagccggggcacagagcgccggacaagctcagcaaagcgcgggagtcccgacggttaagctgtctgacatcgcaacgattaaagatgtcaaaaaagccgaatccatttcacgaaccaatggcaaagacagcatcggcatcagcgtcattaaagcaaacgacgccaataccgtcgaggtagccgacaacgtaaaagctgaactcgaacaattcaaaaaagaccacaaaggcttcaaatacagctcgacatacgatcaggccgaaccgatcaccgagtcggtcgagacgatgctgagcaaagcgattttcggagcgatctttgcggttgtgatcattctcttattcctaagggatattaaatcaacattaatctcggtcatttcgattccattgtcattgttaatcgcactgctcgtcctgaaccagcttgatatcacgctgaatatcatgacgctcggcgccatgacagtcgccatcggacgggttgtcgacgactcgatcgtcgtcatcgaaaacatttaccgccgcatgaggctgaaagatgagccgctgcgcggaaaagcgctcgtgcgcgaagcgacgaaggaaatgttcatgccgatcatgtcatcaacgatcgtgacaatcgcggtattcctgccgctcgcacttgtcggcggtcaaatcggcgaattgttcatgccgtttgctttaacgattgtattcgcgctcgctgcatccctcttgatcgcgatcacgctcgtgccgatgcttgcgcacaccctcttcaaaaaatcattgacaggcgcgccggtaaaggcgaaagaacacaagcctggggtactggccaacttctacaaaaaagtgttgaattggtcgctcagccataaatggatcacatcgatcatcgcggttctgatgctggtcggaagcttgttcctcgtgccgctgatcggagcgagctacttgcctgccacaaaagaaaaaatggtgcagatcacgtacacccctgaaccgggagaaacgaaaaaagaagcggaaaaggaagcgcaaaaagctgaagaaatcctattggaccgcaaacacgtcgatacggttcagtatacgttaggagcgggaaatccgctgatgggcggaagttcaaacggcgcgttgttctatatcaaatatgaggaagacacgcctgattttgatcaagaaaaggacagcgtcttaaaagacattcagaagcaatccaaacgcggagaatggaaaactcaggatttcagctcctcaggcaacaacaatgagttaacgtattatgtgtacggggattctgaaaaagagattaaaggcactgtaaaagagatcgaaaagataatgaaagaccaaaaagacctgaaaaacgtaagctcaggcctgtccagcacatatgacgaatatacatttgtcgctgaccaggagaaattaagcaaactcgggttaacggcatcacagatttctcaggcgctcatgaaagaaacatcgcaggcgccgcttacaaccgtgaaaaaagacgggaaagatcttgatgttacgattaaaacagaagaagaaacatataaaagcgtcaaagatttagaagacaaaaaaatcacaactccgaccggccaggaagtgaaaatcggcgatgtcgcgaaagtgaaggaaggcacgacatccgacacaatttcgaaacgggacggcaaaatctatgccgatgtcacggcggaagtcacatcagacaacgtcacggccgtatcagtcgacgtacagaaaaacatcgacaagatcgacctgcctgacaacgtcacaatcgataccggcggcgtatccgctgatatcgaagattcctttacaaaactcggactcgcaatgcttgcggcggttgcgatcgtctacctcgtgcttgtgattacattcggcggagcactggcgccatttgcgatcctgttctcgctgccgtttaccgtcatcggcgccttggtgggactttacgtatcaggagaaacaatcagcttgaacgcaatgatcggaatgctgatgctgatcggtatcgtcgtcacaaacgcgattgtcctaatcgaccgcgtcatccataaggaagcggaagggctctcaacgagagaagcactcctggaagccggctctacaaggctccgtccgatcctgatgacggccatcgccacaatcggcgccctgattccattggcgctcggatttgaaggcggcagccaggtcatttcaaaagggctcggcgtcaccgttatcggcggtctgatcagttcaacgctcctcacccttctgatcgtaccgatcgtatacgaagtactggcgaaattccgccggaaaaaaccgggtatggaagaagagtaagatggtataacatcaaccccttggaatggacacaggaaatggtccattctaaggggttttttctttgaagagacgatcgtcggtgtttaacaaaaatatcctgtgttatgctttgttagaaaaggcaacttgatgaggaggcattgaatggaatcgaaaggaaacagcgaaccaagccccaaaatcgtaaagcggctcacctggatcataccgatcgtgttgataggagtcatttttctcttaaaaaatatgagaaatcctgtgactgatgttttattttatattgtatgtgcaggtgtcatcatcttagtgattttccgcatcataaaagagacaaaaagcagatgaagcaagttttgaacttgtcgataaaggttgaagtgatcttcatcgacaagcttttttaatgctgcgttctccagccggcgaagaagcggctaatcatgcggattgatcacagccagcagctgatgatcttcccattttccgttgatcttgacgtttttccgggcgatgccttctttgtgaaaacccgccttctccagcacccggatcgaggcaatattacggggcatgacgccggcttcgatgcgatggagcttgagatcgtgaaaggcgaactcgaccatcagcttgacggcttcggtcgtgtagcctttgccgttgtgcttctgatccaaaaaatagccgatgaaggcgctttgcaaggaaccgcgcagcacttggaaaaggttgatcgttccgatcagcgcatcgtttgccggatcaaagatgccaaaataataatcttcatcgttctccatattttcatataatctttgaagcctcttcttttgtccttcgattgtataaaactcctcgttccgctccattgaaaactgttcaaagaacgggcggtttgcgttctgcaattcgaggcatgcctcggcgtcttcagccgtgagcggcctgatgtaaatgtttgtcccttttttaatcatggaaagtctccttttataaagatggaatgcggtcggctcttttcatcaactcttcaaaatacgcaaaaaattgatccctgtcgacttgatcaacgactttgaccattctgccgtcaggatgctcttctgtcgttccttggcgcgggctttgtgtatggacaaccgccttgatgctgcgcgagcgtgtcatatcgactgtgccgagcgtcagcgtcgtcagcacatcccaaaggtagtatgtcgaattcgtttcgttatggacaagcggcggacacatcgcatagcattggccgataaagtcgatcccgatatgctttctgaggctcgcccaatgggagcggatttcgtttgtcaaaggcacctggttcgtgctttcaagcgcgaccatttcgatctgaatgtcgctctcgaataccgtcttcacgctgtaagggtcccaaaaagcgttccattccgccgtcccgtcgtgctcaggctcttccacatttcctttctcaaggaaggtgccgcccatccagacaagctttgcaatgtgctttatgatcgccggctcttcctcaagggccctcgccaagtctgtcagcgggccggtaaacagcagtgtcaccggttcggggctctgcctcacgcattcaatcagatgaaggtgggcgggcagttctgacaccggagtccggacttcgcctttttcatttaaaatcggcagagcgtcgacataaaaggcgtgcatgcgccactccttcgggaacgggtgcacccctctcgaatcggatgccgcagtctcgacctggtacgaaccgaagcggtcaatgatttttcgactggcactgagagcaggctccaaatagcaatccgccggtatgacggatgttccgatcaatttgacatcttccatctgcaatagcagaaataaagagacgagatcatcgacgcctccgtcatggttaaaataaacgggctttttcacagcaacatctccttttttcttaatattaattattttacatcaattagatcctgaagtcttttttaccattaattaggatattttatctaaaattaaacaaatgatgatacccattttgttgcgattttttcaacagctagtataattaaaggttgttggtaaagaaatgatacggatactctaataggatgatgaaaacatgaaacgtgcacgaatcatatacaatccgacttccggacgagaaatcttcaaaaaaaaccttgcccaagttctgcagaagttcgagcaggcaggctatgaaacgtcatgccatgcgacaacaggggaaggggatgccgtacaggccgccagacacgccgctgagcgggaatttgacttaattgttgcggccggaggagacggcacattaaatgaagtcatcaacggactggcgccgttggaacaccgccccaagctcggagtcattccggtcggaacgacgaatgactttgcgagagcgctcggcattccgcgcgaggatattttaaaggcggttgacacaatactagagggagaagcccgtccgattgacatcggccgcgtcaacggccaatatttcatcaatatcgccggcggcggacgccttacagaactgacatatgacgtaccaagcaaattgaagacgatgctcggccatcttgcctattatttgaaaggaatggaaatgctccttccttcactgcggccgaccgaggtcgaaatcgaatacgacggcaagctgtttgaaggagaagtgatgctgtttctcgtcatgctgacgaactccgtcggcggctttgagaagctcgcccccgactcaagcttgaatgacggcatgtttgacctcgtcattttaaaacggacaaacctcgccgaattcatcagacttgtcggacttgccctccgcggcgaacatatcaatgacgagcatatcatctatacgaaagcgaaccgcgtcaaagtgacggtcaaagataaaatgctcctaaaccttgacggcgaatacggcggcgaactgccgggcgaattcgaaaacctctaccgccatatcgacgtcgtcatgtcaaaagaaaaagcgagaaaattggatgattgaacttggtctaaagagctggccaagtttttcttatagcaggtgaaaaagatgaaacaaaaagcccccgttcaaaaaaatgaatattacaatgtcgtatttgaagatttaacacacgaaggagccggcgtcgccaaagtcgacggcttcccgattttcgtgccgaacgcgctgcctgacgaaaaggcgcagattaaagtgacccgggtcaaaaaaggcttcgccttcggccgcctcatcgacttgaaagaagaaagccgctttcgcacggacgcgccgtgcccgatctacaagcagtgcggcggctgccagctgcagcacatcaattacgaaggccagcttctctacaagcagaagcaagtcaaagacgtgctcgagcgaatcggcaagctcgatttaagccggatcaccgtccacccgaccctcggcatggaagacccgtggaactaccgaaacaaagcgcaggtccctgtcggcgaaagagaaggcggcctgatcgcaggcttctaccagcagcgcagccatgagatcatcgacatgaacgaatgcctgatccagcaatcggaaaacgaccgcgtcgttcaagcgattaaagagatctgcggcaaatacggcatcaaagcgtacaacgaagaacgccacaaaggctggctcagacacatcatggtcagatacggcgccgtcacaggcgaaatgatggtcgtcttcatcacaaggacaaacgacttcccgcacaaagcgaaaatcgtcgaagagatcaccgcggcattcccgcacgtcaaatcgatcgtccaaaacatcaacccgaaaaaaacaaacgtcatcttcggcgacgaaacaacggtcatctggggagaagaatacatttacgacacaatcggcggcatcaaattcgccatctccgccagatcgttctaccaagtcaaccctgagcaaacgaaagtgctctacgacaaagcgcttgaatacgccgaattgaacggcgaagagaccgtcatcgacgcctactgcggcatcggcacgatttcgctgtttttagcgaagcaggcgaagaaagtgtacggcgttgagattgtgccggaagcgattgaggatgcgaagcggaatgctgagttgaatggcattgagaacgctgagtttgaagttggcgaagctgaggtcgtgattccgaagtggtatgaggaaggcattgcggctgacacgctagtggttgacccgccgcgcaaaggctgcgatgaggctttgctgcggacgattattgagatgaagccgaagcgggttgtgtatgtgtcttgcaacccgggaaccctggcgcgcgatttgcgggtgctggaggatggcgggtatgcgacgcgtgaggtacagcctgttgatatgtttccgcatacggcgcatgtggagtgtgtggcaattttaacattggtataggggtgatataagcttatatcaccccttgccttttaagattattttggtattccttcccaaaattcaagttcaatagaatttagtgcaagaaaatgaatgcgtatagagtctccgcttattaaagttaggtggaagaatgacgataaatatagtatctattaaaagttctttgcaaatagtacttggtttgtaaaattgttataatattgaatatcgcaaacattttatgggggaaacattaaaatgatcaataattggcacgttccacgcaataagagaaagttatatcctgtagtagatatattatccctttttacattgcaaaccttaggaaataattggagcaacagcttaaataaacaattagattttgaatcagaattagaacgttatggattgaaaagacccgggcaaaggcgcgacaggagggcaggtggagcaaggacctacgaatcttggctctataatttgggacttatttttgaagagactgatacgaatattgtaagaacaacattggctggtgaggcattattaagtggggagcccccagtgccgattattactaaccaattaatgaagttgcagtatccatcaccttattcaataagaagaaaagtgaatattcacaaacgttttcgaataaggccatttagatttctactaaggttgcttgctgatgatagaattcagactttatctaaagaggaaattggccgatttgtaattactgagggagaagatgaatcagatacttgttttgataaagtagtgcagagaataaattgctatcgttatgaaggtgacgcaattctatcttcagattttgaaaaattgtatcaaagtagtaccacaggtttacggacaagagaaaaaaccttgttatatctagaggatattgctaatacatttataaactatttagagtacacacagcttatcggaagagatgcagatggaagaatacatatattaaaagataaaattagtgttgttgacacaattttaaatgatggaacaaatttaagacggcttgatactgagcatccatatggtttagaaaattttcaaaggagttttggtttagctcctggacaaaatagagataaccgtaattttggtggacagactgttacggataatttgtacagagaaagaagaattcgaagtgaattgcttcatattgctaggacaatgccaattgttgattttacaaattctttagcacataggattgccgatgcaactggttataatgtaaaagaagtagaagaatcgttggacggtttccgacctgatacattttcacaatttgaagcaagttatttaaatatggcaatcagcggtactgaacttgcaacagagtttgaaattgcaactggtgaagtatttaaacaattgggtttctgtacagaacatgtaggaagccgttctttgcatcctgatttatttgtggaatctccaaagaagtattcagggataatagatacaaaagcttatagaagatatacgatcagcaatgatcacagaaataggatgacaaacaattatattccaacttacaaaaacataagtggaaatcttgaattttttatgtatgttgcagacggatttggaaacaatattaattctcaactacagaatattgcagatcacgccaatacaaatggaagtgtcattacagcaagaaatgtaattagattgcttcaagctaaccaagctactccaatagaccatgatagattgaaaatgctgtttacaagcaactctgaaataactactgcagatatagattcctgcagacgaagataaaacttgtttattttcaagtgaaagcatatagtgtataatgaaaaatacgaacaaaagtacgaacacttggagatggcagacaatgatttttaaaaaaggagagctgttttgcggtccgggaggtttaactctaggagcaaaaatggctgaggttgaaaaaaacggagtagtctataaagttgagcatgagtgggcaaatgattatgatgaggcaacttgtgaaacattccgacacaatatttgcccagacaagcctgaaactgttatctgcgaagacgtacgcaaattagatattactaaacttccggaaattgattgtttttcttttggatttccatgtaatgattatagcatagttggagaatcaaagggattagaaggaaagtatggccctttatatacctatggaataaaagttttgagacatcatcaaccaaaatggtttattgccgaaaatgtcggtggattggaaagtgcaaacgagggcaaagcatttataaaaatcctaaaagagatggaggattctggatatgaaatcactcctcatctctataaatttcaagagtatggtgtaccacaagcacgtcatcgcataattattgtgggcatccgcaaagacttcggatggaaatttaaggtgccaagagctccttttaaagattcttcgaaatggacaagtacacgccaggcgttagaagagccgcctattcctgaagatgccttaaaccacgaatttacgaagcatcaaagcaaagttatagaaatgctgaaccatattcctcctggggaaaatgcttggtttgatggcattcctgaacatttaaggttaaatgttaaaggggctaaattatcgaatatttataagcgcctaaatcccaatgctccagcctacactgtaacaggttcaggtggcggcggcacccatatgtaccactatgctgaaccgcgtgctttaactaaccgtgaaagagcgcgattgcagacttttccggactattttgaatttttaggcggcaaagaaagtgttagaaaacaaatcggaatggcagttcctccgcttggggcaaaaattattatagaagctgtattaaagtcttttgcagggatagaatacgaaatagaacctgctaagtgggaagaggaattgagcaaaatgttgctaggtgaaaaagcaaaaaaaaatgccgcaactaaaccaaagaaacaaaatcagagtaataatgactcttcaaaagtagagcaaattaaattttcaatataatatttttcagccttgacataaatactgtcaaggcttttatttggaatttattttgactttatcaataaaatcacaagtgtcggcgattgccttatcaaaattttcttttatctcatgttcccaaattctttttatatgccaaccattctctctgtaatattcattcacttttttgtcacgctgttgattgcgaaggagcttgcttttccaataatcttgattgctttttggttcgttgctatgaagaggacaaacatgccaaaagcatgaatcaataaaaataactattttatatttttttatagagatatcaggttttccaaatagagttttagaattttttctaaatctgtacccttttttccaaagtgcttttgtaaatatgttctcaagtttggattgagagcgaatagctttcatggttttggttcttttttccttggacatattatcagccacttaagcacccccctcttatttatctctaataagttacggtatcaatagaacaaagaagagtctgtgtttatcaagaacaccatgcctttactttatgataacaaatagaaaagggaaagataaaatattataattcaatttatcgttgaggatctctatatgaaatgaagtataaagtaatttttattagaagcaaatatagatttgattaaatacatgtattacataaacttatcacctatgctaatctcataaaggcatcatgagcgaagtcgcttcagaagtgttgtggggtgttgaacgagttccatcgctattaggaaataattgcaggccattcgaccaggaaaattccttcttcccaaaaaacaaaataaatgttgacgctttcataaaaccgatatatactttaatcaaatccaatattgataaattagacatgtgactggtcatgcaggcaggatctaaaaccgataaattttttaatttgtcggtttgggtcctttttttattgcctaaatataggtctcatgtttcagaaaagggggagaaacagtgaattacatacaaacagcaagagacgtattgcagcatgtcggcggtaaagagaatattgcccatttggagcattgttcgacacgactccgttttacattgattgatcaaaacaaggcggatgtacctgcgcttgagaaaacaccaggtgtcatcgctgtccgtatgtcgggccaatgccaggtcgtgattggaaacgatgtcatcgaagtctatgaggaattgaccggccttctcggcggagcactttctggacaaaatgggtcttcccatcagccgaaggaaaagcgaaaagtggggactgtactattagacttcattgtcggtgtttttcaaccgcttgttccagccattgcgggtggagggattttaaaatcgtttctcctcctcttctcgttattcggattcattgatgccaaagggcaaacgtatcagattttaaatatggttggcgatgcgccgctttacttcctgccattgctagtcgccgtgacgacagccaataaactaaaagtgaatccgcttgttgcattatcggcagtcggcgctcttattctgccaaacatgacggcgatgctgacagaaggcgctcaattattttcattcgatgtgaaaaatattgcgtatgcctatcaggtgtttccggcgattttatctgtcctgttgtatacacaggtggaaaaatggtttactcgtatttcgccaaaacccattcgtatcttcttcgtaccgatgatgtctttggttattacagttccgatcactctcctgctgctgggaccaatcggttttacagcagggcaaggcttcacagcactcatccttgctatgtttgacaaagtaggctggattgcagttgcgatccttgcagcggttcttccatttatggttgcatcagggatgcacaaagcgatggtgccgtacgctgtaacaacaatgggcaatctcggaaaagaagcactttacttgcctgcatcacttgcacacaatatcgccgaaagcggagcgtgtttcgcaattgcccttcgtacaaaagataaagtgcttcgttcaactgccatttctgcaggaatttccgcattctttggcattaccgaacctgcattatacggggtgacactgcaaaataaacgtgtgctcagcagtgtcatgatcggttctttcatcggcggcatcttcattggacttgtcggacttcaagcgtttgttcttgttggacctggtcttgcaagtatgtcgatgtttatatctgacgagcttccacgcaacttcatgttcgcagtgattggttttgccatctcatttgctgttgcgtttgctgctgcctttattttaggaaaggatcgaaagacagaagaaacagaaaaagaagcagagccaggtgttttcgctgaaaaacttggcgcagatgagacgttcaaaagtccagtcatcggtcaaatgatttcactgtctgatgtagaagatgacatattctcttcaaaggtaatgggagaaggaattgccattattccttcaaagggtgaactatatgcaccgatagatggcgagatttctcttctctttgaaacaaaccatgcactcggtatgaaaacagcaaacggagttgaggttcttttccacattggaatcgacaccgttcagctagagggcaagttctttaaaccattggtaaaagtgggggatcaagtcaaagcgggtgatctgctcattcaatttgaactggagaaaattaaagaagcaggttatgatccagttacactagcagttattacgaatacggatcaatatgatataaaagtcacgcaattaaaagaggtcaatcgtcaagatacgttgatggttgttacacaattaggagggtaatcatgatgacaaaaacaaaaggatttccgaaagactttttatggggcggggcgattgccgcaaaccaagcagaaggagcctggaatgttgatggaaaaggaccgtctgttgctgatattgccatgtaccgttcgaatttgagtgttgaagattacgaaggacatcttgctgtttcttctgaaaacattgatcgtgcaatgaaagacccggacgtaaaaaaatatccgaagcgcagagggattgacttttatcatcactataaagaagatgtggctctctttgcagaaatgggttttaaaacattgcgtatatcgattgcatggagccgaattttcccgacaggagaagaagcagagcctagcgagaaaggccttcagttttatgatcgtctgtttcaagaaatgaaaaaacataacattgaaccgatcgtgactctgtcacattatgaaatgccattagcacttagtctgaaatacaacggatgggttgaaagaaaagtgatcgacctctttgtgaagttcgcaaatgtgtgttttgaacgctataaagatgtcgtaaaatactggcttacctttaatgaaattgacagtatacaccgccattctttcattacagcgggaatcattcctgatcgctgtcctgaagggaaagtagaagaaacggtttatcaagcattgcaccatcaatttgtggcatccgctcttgtgactgcagattgtcatcgcatcattcccggcagtcaggtgggatgtatgctaacgaaactcacgacatacccgcacacttgccatccgagtgatgttgaacgcgcactgaagcaaaaccttgataactatttctatgcagatgttcaagtgtttggcgaatatccgccattgatcaaacgcatgctggaacgaaaaaatatcaatattaagatggaagcggacgatcttgccattataaaagaacatacggtagacttcgtttcgtttagctactatatgtccctgacagaatctgcacaggagggtctggaaaaaacagatggcaatacgattcgcggtgtgaaaaatccatatttgccgtcaacagattggggctggcaaatcgatccggtcggcttaaagatttcgctcattgaattgtatgatcgctatcaaaaacctctcattattgtggagaacggcatgggtgcgaaagatgttgtcgaaagcgatggatcgatccatgatgactatcgtattagctatttcagagagcatttccgtcagatgaaagaagccattgaagaaggtgttgatctctttggatataccagctggggacccattgacattattagtgcgggaacatctcaaatgtccaaacgatatggatttatccatgttgatcaagatgacgatggcaacgggacattgaagcgctcacgtaaagattcattctactggtataagaaagtgattgagacaaacggagaagtattagactaaaaaaccgcattcatgaaaaggtgatggcgatgtttaaaataaaaaaagttttaaactcgagtgtggtactggctgtagaccagaaccgacaggagatggttttatgcggcaggggcatcggttacggacgaaaacctgggaatatgattgaagaaaaacaggctgatcaagtgtttatgccagtagacaatatgaaggcaaaggaatttctccaactgttggattcaattccgcaagaatttattgaattgacccagcaaattgttcagcatgcagaagaaagattaaaaacaaagctaaattccggtgtatacttcacattaatggatcacttgaattttgcagtagagcgctataaaaagaacatcaatattacgaatcgcgtctactgggaaattaaaaactactatacggaagagtttgaggcagggaattatgcgcttcagctcatcaatgaaacatttgggatccaattgccgaaagaggaagcggcaaatattgcgttccacttaatcaatgcattaggtgaagagacagagtcaaaagatggaatgaaaaatgcaaaaatgatcgggagcattgtcaaccttgtccgttacacattaaacatgaaattagatcaagaaaacatccactacagcagatttatcacacacgttaaatttttcgttgaaagattttacgctgataaattgctggcaaatcaggagaatgaattatttgagcaaattgctaatttatatccgcaagcaatggatgtagctttcaaaattaaggattatatcaagcaggtacacggaaacgtcattccgaatgatgaactgacatacttggcagtccatattcatcgattgatttcttatcagcaattaaaataaatgagagccacttgcctttgtggaaggcgagtggtttcttgtttttgaaaaagaaggagcgttttttgtttataggcaagatgagttgttgatcactaccaacagttgaaattgacaacaaaaggctttttcaattgttgacaaaaacagattactaattgacaaaaggtcattacaaaaatttacacgtgtgataagatcatgttaaagatagagaacaatcttaaaaagaaagagggggttcggcatgagcaaggtcgcttcagaggtggttgcgggggtgttgaacgaattccatttggccattaaaaagcacgatactgagcaggcaaagcatctttttgatgaggcgaagtcgatgttttccgagatggaagaggatcagaatgtgctggcttatttttcgcttcttgaggagcggtaccggatgatgctttatgatgcgaggggagagcggctgccgcgggagtcttactttaatgattcgcaaatcgagtgcatcgagcagacggatcatatgatcgattactatttctacttttttgaggcgatgcatgaagcgtacaacaagaatgttgagcgggcgatcagtctgtacaaggttgccgagaaaaaactggcgaaggtgcccgatcagattgaagcggccgagttttattttaaagtgtcctggctgtatatgtctcttcggcaaaatgcggtttctctcaattatgcgagagacgcgatgaatatttacaaaatgcatgacgggtacgaaaaaaagctggcgatttcccaagttgtgatggggacaaattacatgcagatgcagcgctttaaagatgcggagaagtactttgaagaatcgattgaaatttccaaaaagattgacgattcatttttagaagcgatgcttcatcacaatatcagcattctgtattccaattccggccggtctcaggaatgcattctcgccgtccagcatgctttgagcaacgccgaatggtgcaagtcaagctactatatcaactcgctttacatgctgaccagagagtttttcaaaatcggcgaaacagaagcggccctgttctatcataaaaaaggacaggaggaattaaagaaaaacgggaataagcattatgaaaagaaaataaatattatttatgagctgtattgccatgaaaacgtaaaaagcatcaaagacgacatccattccttggacgagatgaatgatttagacggtgtctgcgatctttctttgctcatctcaagctattttgagaaaaaaggagatgacaagaaagcgctggaatttgttaaaatattcatgaaagccgaaaacaaaatgagatcattagggagtgaggtattgtcatgaaaaaattaattctttgcttgtcgttaactgctatggtcttaggcggagctgctttatcccaaagccacaatcaggcgtcaggcggcgttcaaacagcggagctgccggttgggggttaatgttcgctgaagtccttttacagggcttcttttttaaatcatgaaacggggtgtggaattacaatgaatctgccagagcatgaaatataaaaaccttccagattcgcgagaggccctccaatcgtttaaaacatatttaaacattaaaaattggaggggaatattatgaatgacaaaacatttctttcatatttaaagcacgcagacaagcctttcagcggctgggatttttctttcattgaagacacaggacgaatgaaaagcgacctgctttcatggtcatacggaagcatggctctgtctcttatacaagattccaaatccatgctcgatatggggacaggcggcggcgagtttttatcgaaattggggccgtttcctccgtcagcatacgctactgaatgttatatgccaaatgtgccagtcgcaaaggaacgattgacgcctttaggggttcaggtcgttcaaattgatgatgatgaagagcttccatttgaatccggccaatttgacctgatcatcaataaacacgaatcatattcagcacaagaggtgaggagaatcctttcaaaaggaggactgttcctcactcagcaagtcggcgggcatgattgcgaagaaatcaatgaaaaacttggcgtgccgctaaatgaagaatttaaggattgggacttggaaacagcgttaaaagaaatagaaaagcaagattttaagattctaaaaagcagggaagagtttccagtccaaaggttttatgatattggggctctggtctattatttgaaagccattccctggcaggcgcccggttttgaagtgaatcaatacaaggatgaattgtacgagattcataaaatgattgaagaaaagggctattttgacgtcacacagtaccggtttatgattttagcggaagcgatttagagtttgatcaaagattgtgcctaagaagggtgtctcatattatatggtgacatccttttttttcttaaagccggttatttatccatacatcaggaggaaaagcgatgtcatcccaaactgttaccaattattttctcgatagtgcggctgcgactattatgcgatgattgttacggtgcttgctttttactctattcgttcatttggccggaatcgtgtttgtgattgccggaatctttgtcacggttgtgaagaaggagcagaagaaaggcagcggaaaactcgcgtcttagaaggatttccaaaaaaatgtcgtaaattcgatgcatcaatttgatgaaatcgcccggccctggggtataatagattttgtgaatgaaagattcaatgttgaaagagagtggttacatcatgggccgtaaatggaacaatataaaagagaagaaagcgtccaaggatgcgaatacgagccgaatctacgcgaagttcggccgcgaaatctatgtggcggcaaagcagggagagcccgatcccgaactgaaccagaacctgaaattcgtgcttgagcgcgccaaaacatacaatgtcccgaaagcgattattgagcgggcgatcgaaaaagcgaagggcggctctgaggaaaattacgacgagctgcgctatgaaggcttcggtccgaacggagcgatggtgatcgttgacgcgttgacaaacaacgtcaaccgcacggctgccgatgtgcgctccacatttggcaaaaacggcggaaacatgggagtgagcggatctgtcgcttacatgtttgatccgacggccgtcatcggctttgaaggcaaaacggctgatgaaacgctcgaattattgatggaagcggatatcgatgtccgtgatattttagaggaagacgatgcagtgatcgtctatgccgagcccgatcagttccacgccgtacaggaggcgctgcaaaacgccggcattactgagttcacggtggccgagctgacgatgctcgcgcaaaatgacgtcgcccttccagaggacgcgcgcgcacagtttgaaaagctgattgacgcgctggaagatctggaagacgttcagcaagtttaccataatgtcgatttaggggcgtaaaaagaggccctgaaaaaatcgggaaagaaaagatagatgaacaggaggacgacctgttttgtctatctttttttattgtaaagttaacttgacattttatttttttgttaagtatactttacgtatagtgaactttacattcccaatggaggaaagatgaaaacgttaataaaggaaaagcgcacttcgctgaacatgacacaagaagaactggctaaaaggcttaatgtgtcgaggcaaacggtgatttcccttgaaaagggaaaatataaaccttcactcgttctggcgcataaactggctcaaatttttgaatgtctgattgaagatttatttatttttgagggggatgaaaatattgactgaaacgatgacaaacatactgatcgctttagcgggcttaggaataggcgtgctcgggatcgcaattgtttacaaagtaaacagacgaattggaaaaaaagagaggctgttcgatgagcgccagcagaagattagctatcaggctaaggcgctctcctggaacattacaatggcggccattttaattgcctgggcgttggtgatcattttccaaggaatatccttttcatttttcctaataacaggtttatatatcctgcaatatttatcaatgctgatcacaaccgtttatcttgctcagaaaaactgagcggtgctgttccccttgcatccggattttaccgatttatcggtaaaatctttttttatatccaaaagacccataagattgaattttcttgaaagattgccgatacataagatgtagtctaacttttcccaaaactgtttgataggagatggactgaatgattcaaataactgacctcaaccgtcaatacataggaggggaatggagagacggccaaagtgaaagcgtgttggccgatctgaatccttttacccataaaacgattgcctcttttcggaaagcgacgcgggaggatgtcgatgcggcttacaaagctgcgcttgaggcgaaaaagaaatgggatggcgtcaatccctatgaaaaaagggcaattttagaaaaagccgcggcttatattgaagacaatagagaagcgattgtgtttctcattatggaggagcttggcggaacacggctgaaagcggcttttgaaatcgatcttgtcgtcaatatgatcaaagaagcggcgggcttcccgctcaaaatggaaggcaaaattctcccttcaccggttgatgggaaagaaaatcggatataccgcattccggcgggagtggtcggcgtcatcagtccgttcaattttccgttctttttatctgtaaaatcagttgcgcccgcgcttggcgccgggaacggcgttgttttaaagccgcatgaggaaacaccgatttgcggcggcacgctgattgcaaagatttttgaagaagccggtcttccgaagggactgctgaatgtcgtggtcacagatatcggggaaatcggcgacagcttcgttgagcatccgattccgcgaatcatctcgtttaccggttcaacgaaggtcggcagctatatcgggcagctggcgatcaaacatttcaaaaaaccgctgcttgaactcggaggaaacagcgccttgatcgttctcgaggatgccgatttggaatacgccgtcaatgccgcgactttcagccgcttcacacatcaagggcaaatctgcatgtcggccaaccggattcttgttcaaaaagaagtgtatccggaatttttaaagctgttcagccaaaaagtatccgggcttaaaacgggcgatccgctggaccctgaaaccgttatcggccctgttattaatgaacgccaagctgaacatttaagaaaatcgattgaaaaaggcatcgaagaaggcgccacaccgcttctgaaaggcgatattaaaggcaatctcgtcgagccgacgattcttgcggatgtcacgcctgatatgtctgtcgccaaggaagagctgttcggtccggttgtatgcgtcatgccgtttgagaccgaagcagacgcggttgagatcgcgaatgacacgcctttcggactgagcggagccgtacacacgggaaatgtggagagcggcgttgccatcgcaaagcaaatcgagacgggcatgatccatgtcaatgacacgacgatcaacgatgagccgcatgtcgctttcggcggtgaaaagcaatcggggatcggaaggctgaacggagagtggagccttgacgaatttacgacattaaaatggatttccgtccagcaccaaaaaaggagttttccatattaagaggaggatttgatacatgaatgaagcagtaaaaacggacatccacccgctgctggatgcttttgtgaaagtggcgccgttcctgaatcagctgattcaggacgatgtgacagtggggatttacgataccgaaaagctgatcgtcaacatcccgggaaagacattttccctgaatgtcaaagcgggtgaccctttgcaggaaggcgatattattacagacgccatccgccaaaacaaaaagaaagtaagcatggtgcctaaggagctgttcggcttccctcttgcggcgagagcgatcccgctccacgacgagaacggaagggttatcggcggagtcgggctcggcacgagccttgaaaaatcggatcagcttcaccgcgtcgcggaaagcctgtcggtcatcgtcgagcagacggcttcggccattcaggatatcgccgaatctgtcagcggcttctccggacaaatgtccgacatctccaagcaggcgaaggaagtcagtgaaagcgccggagaaatcgagaaaatttcagtcaccgtaaaaggcatttcagatcaaagcaacctgctcgggctgaacgcggcgattgaagcggcgagagccggagagtcaggaaaagggttctccgtcgtcgccgacgaaatccgcaagcttgcgacacactcaaaagaaaacgtcggccagattgaccaaatcacgaagaaaatccacgcgttattaaaagaccttgagcattcgatcgaagtcatcaatgaacatacgagcggccaggccgcaggtgttgaacaaatttccgccacgatgcaggagatcagcagcaacgcgcaaaaccttgccaagatggcggaacaccaatttgaagactagaactttcacaggcccgctggcaaaatcggcgggcttttctaatttttcatttattaaaattttattttaaattttttagaggaattttccccggtcaaagcgaaaagtgatgaatgggaaaccgctttcaagggggatgggatagatgagagtatatacaacgactaaactgaccggattgttattggggccgatcagttttttgctgattctcggcttgataccggaagctgagctggcttacgcgccgcgaatcgttcttgcggttacagcctggacggccgtctggtggattacggaagccgtgccgattccggcggcatcgctcttgccagtcattttgctgccgacattgggtggtttagatatggaaacgacggccaaagcatacggcgatccgattgtgtttatgtatatggggggatttatcattgcgatcgccatcgaaaaatggaatcttcataaacggatggctttgcacattttaaagcggatcggggctgaaagccaccggatcgtgcttggcgtgatggcggcgactgcgtttttatcgatgtggatttcgaatgctgccaccgctttgatgatgcttcccgtagcgctagcagtcattaaagaagtgcaggaaaaagaaattttaaaaggcgaatcgctgcagaagttcagcaaaagcattttgctggctgtcgcgtatgcggcgtcgatcggcggacttgccacattggtcggttccgttccgaacgcggtgtttgccgcgatgtccaagcagatgctcaatcacgaaattatgttttttgaatggtttttattcgggttcccggtttccattctgtttcttgccattttatatgtttatttaacgaaaataaaatttaaagtgagcgcttttcaaggaaaaaagcctgattttatcgatcatgatttaaaggcgcttggcgcaatgacgagggaggaaaaatcggtttttaccgtttttttattaaccgcatgtttgtggatgttcaaattcatccttccgtttcaaatatcagatacgtcgatcgcgattttcggagcggttctgctgtttttaattccgagtacaaaggatgaacggattttggaatggaaggatatgcagtcgctgccatggggactgcttctattgtttggaggcggcttgtcgcttgcggccggtttttcggcgaccaatctgacagcatggatcggcggcaagctcaagctgttggaaggccacccttacttatttgtcctgattattttgacggctgcgattttatttatgactgaaatcatgtctaatacggctgtcgccaatatggtgattccgatgacgatcggccttggcgccgcgcttcaggtcgagccgtacgggctgatggcggcagctgcgcttgcttcatcgtgcgccttcatgcttccgatctccaccccgccgaatgcggccgtcttcagctccaatctgctgacgataaaggatatggtcagggcgggcttttggctcaatatcgcaggtgtcttcttgattgtgatcagcgcatatttttggcttccggccgtctttcaataatgtccgcgaaaaagctctcactagttttcttgcatcatctgcattaaaataaagttatgacattacgttaggattggtagacagatgagcatttttaaagcggaaggtttatataaaacttacggagacaaaacattatttgaccatatatcgttccatattgaagaaaacgaacggatcggcttgatcggaccgaacggaacgggaaaaagcagcttgctgaaagtgatcgccggccatgaatcgaccgaaaaaggagacatcacaaagcccggcagcctccatatcgagtacttggatcaggatcctgatttggacggcccggaaaccgtgcttgagcacatttattcgggagattccgtgatgatgcggacgatgaggacgtatgagcaggcgcttcaggagctgaatgcggcgcctgatgatccgaagaagcaggaaaacctgctggcggcgcaggggaaaatggacgaacatggcgcctgggacgcgaatacggcggcaaaaacgatattgacgaagcttggcgtcgcggatgtggcaaaagaagtgagctccctttccggggggcaaaaaaagcgtgttgcgattgcgaaaacattaattcagcccgctgacctcctcattttggatgagccgacaaaccaccttgacaatgaaacgatcgaatggcttgaaggctatttgagcgggtatccgggctccgtcgtcctcgtcacccatgaccgctattttttaaaccgggtgaccaacaggatctatgaactggatcgagggcgcctatacacatacaaagggaactacgaagtgtttttggaaaagcgggccgaaagagaagcgctcgccgaacaaaacgaaacgaagcggcaaaaccttctcagaagggagcttgcttggctgagaaggggggccaaagcccgttcgacaaagcaaaaagcaagaattcagcgggtggaggaactaaaggagcaggacgcgcctgaaaccggttcttcccttgatttcgcgatcggctcccaccgtctcggcaagcaggtgattgaagcggaaggcgttgacatcagccgcggcgggaatcagcttgtccgttcattcaatgaactgattgtgccgggggaccggatcggcatcatcggaccgaacgggatcggcaaaacaacactcttaaacgcgcttgccgggcgcattaagcctgacggaggacagatcacgatcggccagaccgtaagaatcggctattatacacaggatcacagcgaaatgaacgatgcgctgcaggtcgtcgaatacatcaaggagacggctgaggtcgtcaaaacggccgacggacaagtggtcacagcggagcagatgctggaaaggttcctctttccgcggagcgtgcagcgcaacttgatccgcaagctgtcaggcggggaaaagaggcgcctttatctcttgaaagtgctgatggaggagccgaacgtcctgttcctcgatgagccgacaaacgaccttgataccgagacgctcggcgtgctcgaagattatttggagcagtttcccggcgttgtcgtgaccgtatcccatgaccgctatttccttgaccgcgtagtcgacaggctgcttgtatttgaaggcggcggaaacgtatcgcgttttcaaggttcctacagcgaatatatggagaagcaaaaggagaacagccgtcaaaagccggcgtctgaagccgcagaacctgtcaaacctgagaaaaagaaaaggaagaaactgtcttataaagatcagctggaatgggacggcatcgaagacagaatcgccgctctggaagaaaagcataaacggcttgaagaggaaatcgccgccgccggcagcgattttgccaaaatccagacattgatggaagagcaggcgcaaacagccgaagagctcgaagcggcaatggagcgctggacagagctgtcgctgttgatcgaagagcttgaacaatcgtaactgtctgctgatggccgcattatgtgttctcttgtttataaaagcaatgggctgccgcaaagaaaacagaagaggctcgctggcattctttatgatgttcagcatcgtctgcttgaccacgctcatcattaaaattgtaaagctcggccattttttcggccgagctttttaacatttggaaaacgacagccgcgccacggcatcgtgcaagtgaatcgattcttcgttccggcattcgatctcaaaggcggagatccagtccatttcgtataagtcggcagctgttaagcggaggacgtcttctacaaatcttggattctcataagcctgttcagtcactctcttttcatcgggtctttttaagacgggatggagctttgcgcttgcgttcgtttccgctgcggcaagaagctcggctttgaaatcgtccggcatctccgcctgttcattgatatgcgcggtgatcttgattatgccgcgctggttatgggcgctgtattcgctgatttcttttgaacaagggcagagcgtcgtcgcatgggcggtgatgccggcggtttgcgaaaagcctttgttttcatgataagagactgtcatatggatatcggcatgcatcagtccggacaatttggtttccgggctgatgcgttcgaaataccatggaaaactgacggagacggatgcgctttcctgttccatattgccggctaaatcctttgcaaaatctttcagtgtatggaagtcaaccgtccagtttgcttcgtgatagcgctgcagctgttctgtcaggcggctcatattgattcctttgcggtcgcgcgcaaggctcgtcgtaaaggaaaaagcgccgatcgtcgtttgtgtaaacggcttgagcgaggaagcaatcaaaatcggatgcgaaacgtttgagacaccgacatggtcaatgtcaaaaaaatagtcgttcggtgtattttgaatatccttcatctgttctttatcagtcggttttattcctttcacggcttcgacagatccgaagcggcggtggcgttcgggttttgcgggcaaatgcagtttgcgttccattgatgagacccctttcttcagtaaatagaaatagttcctatttattttgaggcaatgctgtgataaaatcaagtggtcatgtctaaagcatgcaaattaaatcgaaatgatttcgtttagggagtggttgttttgcagcatagcgaaatcgtcattgttggagcgggacccgcaggtattggaatggggatcgttctgaaaaaactcggttttaaatcgtttacgattttggaaaaagaccgtgcaggagcttcattccgaagctggcctgaagaaatgaaactgataacgccgtcctttaccgggcagggattcggggctttggatttaaacgctgttgctccgggaacatcccctgcctttacttttcaacgcgagcacttgagcggacgggagtatggagattatttggcgcttttggccgatcattttcagcttccaattcaagaaggcacatcggttcgcagcgttcataaagacgacggcggtttttcagttgaaacagataaaggcactatgaaggccaaagacgttatttggggagccggtgaattccaattcccgaaatattcgtttcatggtgcagagattggcatccacaacagcaaggtcgccagatggagccaatttgaaaaagcccatttttacgtggtaggcggctatgagagcgcaatggatgcggcggtacaactggcgtcctatggcagcgatgtgacggttgtgatgccgaattcgctccgcgaaaacgctgaagccgatccgagcaggtcgctttcaccttacacatgggagcgtctagaagatgcgtatgaaaaagggaaggttcagtttttggaaaaagccgttgtagagaaactggcgaaaaacggaccagcctatgatttatatttgtcagacgcgaggaagatccgttcggaaacacggccgattatcgcgacaggctttcattccggcgcaaaacaaatcgagcatttgtttgaatggggagagaacggcaagccgcttttaacaaatgaagacatgtcgaccgtgacggacggtctttatttaatcgggccgagcgttcagcatcaaaacgcggtcttttgcttcatttataaattcaggcagcgattcgccgtcatcgccgagcatttgttgaaaaaacgaaggttttcgatcgatgaaaaggtgctgacagaatacagggaaaatcaaatgtttctcacagatttgagctgctgtgaggtgcagtgtgaatgctgaaagaaccaacgcggcggcagcgcatgctcttcatcggactcgaatcggtcggaaaaacaacgcttttttcagcgatcactgatcagagggcaggcgaagcagcaaatgtgaaaggatcgacgatatttgcggctgaacgggagatcaaaagccttccgggctggcaagccattgatacaccgggcattcgggaggatggcagcgtgtcgaaacgagcgctgaaaaaagagatcgaaaaggccgatgaggtggttgccgtcttgcgcggcacccatttttctgaagagctgaacgcggtcttggagctgattccgccggaagcccggcgcgtctgctttatcgttacgtttcaggataaaatgacggacgccatgcgccggaagctttctgagcaagtggccaagcacagtctcccggtcctgctggttgatacgagaaccgtgacagacgataaaaaagagcggatcatcgcttttttaagaaaagaggctgaatttcatccgctcaaacggaggcggatgaaacagattgaacttgaaagtgtggctgttcagcagtctgtgtttcatcgtcccgtagcggggcctgtagtgagcgctgcacttttatgtttgttgtttatggcgccgatcgtattggcttatcatacatcagagtgggtgcagcaatctgcggacaaatgggcggttgtccgctccaaaatgcggtcgggggcttgccgtcatggctgggcgcggcattggcggggaactatggcctgttatcccttggcatttactcgtttgtttgggcgtttcctgtcgttttgtttatgtctatagcgaatgcggcagcggatgattcgggtttaaaggaccggatcgtcgattcattggacccgctgatgcggaagatcggtctgaacggccgtgatttagttccgcttttgaccggatttggctgcaatgtcgtggccgttcagcagacgcggtcatgcagcatgtgtacgagaaagcgctgtgtatcgtttatttctttcggatcagcgtgcagctaccaaatcggtgcgacgctgtcgatttttcatgctgcgggaagggagtggctgtttattccttacctcgctgttcttgttgccgcagcggccgttcataaccggatatggtatcgcatcgatcagaaatgggccgcttacttcgagcgacggcaaacgtttttgcagaagccgtcctggaaagggatcgtctttcgagtaaaagaagtgcttcagcaatttatctttcaggcgatgccgatctttctcatcatttgcctggcggcgaccgtattgaatgaactcggtgtcatccgtcttgtgacattgcttgtctcgcctgttttaagcctgttcggcgctccagaagatgcggcgcctggccttgttttttccctgatcaggaaagacggcattctcttgttcaatgaagggaatggagcgcttcttgacatgctgccgggagcaacgctctttctgctcatttacttggcatcaacctttactccatgcatggtgacggtttggacaattgccaaggaactggggatgaaaacggcggcagccattatgggaaaacagatggccacttcagtcgtttcggttttgagcatcatgatcatctggaagctgacgctttgcatttttaaataaagtgtggtgaaataaaatataaatcgtaataattacgatttgataagaggaaggagaatgaaaaaatgagtaaaaagattcctgtgacagtattaagcggatacctgggggcgggtaaaacgacgctgctgaatcacatattgcaaaaccgccaagggctgaaagtcgccgttattgttaatgacatgagcgaagtcaacattgatgcagggcttgtcaagcaaggcggcggcctgtcgaggacggatgaaaagctggtcgaaatgtcaaacggctgcatttgctgcacactcagagaggatttgctggttgaagtcgaaaagctggcgaagcagggaaatattgattatatcgtgatcgaatcgaccggtatcagcgaaccgatcccggtcgctcagacgttctcttacatcgacgaagaattgggtattgatttgacccggttctgccgcttggacacaatggtgacggttgtcgacgccaatcgtttttggcacgattttcagtcgggggacagcctgctggaccggaaagaggctgtcggcgaagaggatgaacgcgacatcgccgatctgctcatcgatcaaatcgagttctgcgatgtgctgattttgaataaatgcgaccttgtctccgaggaagatctgcaaaagcttgagaaagtgctgaaaactttgcagcctaaagcaaacatcatcagagcggtcaaaggagaggtcgatccgaaggccgtcttaaacaccggtctcttcaattttgacgaagcgagcggttcagcaggctggatcagggaattaaaccaaggacaccaccagcatacgcctgagactgaagaatacggaatatcttcgtttgtatacgaagcgcgccgtccttttcatacagagcggttttataactggattcattcgctgccggaaaacgtcgtcagggcgaaaggaatagcctggtgtgcgacgcgcaacacccttgcccttttgatgtcgcaggcgggtccttccgtgtcgctggaaccgatctcttattgggtggccgcactgtccaaaccggaacaggaacaaattctcagacagaaccctgagcttttaaaagaatggaatgaagaattcggagaccgccatacaaagctcgtctttatcggattggatctgtcgccgtctgaaattaccgcagaagcggatcgatgccttttaacagattcggagatggcggccgactggtcgcttttatctgacccgttcgattggcagattgaaagagctagataattctaaaaaaagacaaaagagagacatctcttttgtcttttttatttccaacaaaccggtgttttggacgcgatgttgacatatcaggaaaggaatactaatattttattgtaatgttaactctaattaataataggttaacatatgaacgagaagggggatgaaagcatgaagggggaagcgtattacagtgtgagaatgagagcctccgagaacggtccccatgaagaggggggaaaacacatatccggaggagagcggcttgtgcctttcatcggtttaaatgatgccgtcagcgatttattggaaaaaggtatgtctcattcgcggggcaggccggactttatgcaaattcagttcgatcttgtaaacgaaccgataaagcttgttcaacctttgcgcattgaaacgaatgaaacggtatcagcggaagaaggacaagcgctcgcccgtgagctgatcagccgcgccggcgtgccggaaagcgcggttgaaaaagcgtttcaaggcattgccgaatactggggcgtgaggggcgccgttttgtttgatattcattccggccggcggattgacggaagaaaagaaaaaggagtgcgcgtctcgcggctcgattggccggaggccgattttcaaaggtgggccgctttgtgcggggtgccgccaaatccacggttgaaagaggcgcttgccatcgcctcaaaggtatgtgagcacccggccgtcatcgccgaattatgctggtcggatgaccctgattacataacgggctatgttgcggctaaaaagctgggttatcagcggatgacaaagatgaaagagcatggggacgaaagcggctgccggattttttttgttgatggatcagcagatgtaaaaagctgcatagacgatttggaaaaacagcctgtattcattggtcaggaggtaaatcatgaatcaatcattcgttgagaaaagcaaacaatatctttggctgccttttacccaaatgaaagactatgacgaaaacccgctgatcatcgaaagcgggcagggaatcaagctgaaagatatcgacggcagggtgtactacgacggattttcttcagtatggctcaatgtccatggccatcgcaagaaggaactggatgaggccatcaaaaaacagctcggcaaaatcgctcattcgacattgctgggaatgacaaatgttccggcgacagaacttgccgaggtgttaatcaagatcacgccggaaaatctgacgcgtgttttttattcggacagcggcgccgcagcaatggaaatcgcgctgaagatggcctttcaatattggaaaaacatcggcaagccggagaaacaaaaattcatttcgatgaaaaacggctatcacggcgatacgatcggcgctgtcagcgtcggtgcaatcgagctcttccaccatgtatacgggccgcttatgtttgaaagctttaaggtgaacgttccatacgtataccgctcgaaaagcggcaacccggacgagtgccgcgatgaatgtctcgcagaactcgaacggctcctgagcgagcggcacgatgagatcgccgcgatgtcggtcgaatcgatggttcaaggggcatcagggatgatcgtgatgcctgaaggatatttggcaggcgtccgggagctctgcacgaaatatgacgttttaatgattgtcgatgaagtggcgacaggattcggccgaaccgggaaaatgtttgcctgtgagcatgaacgtgttcaacctgacttgatggcggctggaaaggccattaccggaggctatttgccgatcgccgtaacgtttgcgacagaggaaatttatgaggcgttctatgatgactacaacaaactcaaaacgtttttccacggccactcatacacggggaaccagcttggttgtgccgttgcgctggaaaatttgcgcctgttcgaatcggaaaaaatcgtcgctcaagttgcggaaaagtcgaaaatactggaatcgctctttcacgatctggcagcgctccctcatgtcggcgacatccgccagctcggttttatgagcgggatcgagctcgttcagtcgaaggaaacgaggcagccttatccgcccgaagagcgaatcggataccgggtgtctttgaaaatgagagagcttggcatgctgacgaggccgctcggggatgttgtcgcatttcttcctccgctcgccagcaccgccgatgacctgcgcgccatggtgtcgattatgaaagaagcgattcaagaggttacaggccgtgcgtattgatgaatggctcagcagccggctcgcaaagacgaaagcagccgggctttaccgctcgcttaaactgcctcaagctgaacgtacgaattgggcgtcaaacgattatttgggcctggcgaacgacaaacggctgattcatgccgcagaaacagcgctccgccgctttggagccggaagcacaggatcaaggctgacgtcaggcaataccgcatggcatgaaaaacttgagcggaaaatcgccggttttaagcagacggaagcggctctcttgttttcaagcggatatttggccaatgtcggcgtgctttcgtctttgcctgaaaaaggagacgtcatattaagcgatcaattgaaccacgccagcatcatcgacggctgccgcctttcaaaagctgatacggttgtttaccgccacaaggatatgaatgatcttgaagaaaagctccgcgccgcacagagccgtgcacgccgctttattgtgacagacggcgtgttcagcatggacggcacgattgcgccgcttgacgaaatcatgctgctcgccaagcagtaccgggcctttgttatcgtagatgatgcccatgcaacaggggttttgggagaagccggcaggggaacgagcgagtatttcggcgtctctcccgatgttgtgatcggtacgttaagtaaagctgtaggcgcagaaggcggcttcgtcgcaggttctaaaacattgatcgattttttgctgaatcatgcgagaacgtttatctttcaaacggctgtcccgcccgcaagctgtgcggcggcatgcaaagctttagatatcatcgaagacagccgggctaaacgccggcttttgcaatcatcggtgaacacgatcaaacggagtctcgtggatatcgggtttacggtcaacggagaagatacgccgatcatacccgttatgatcggagatccccaaaaagctgttcaatttgcaaacggcctgaaggagaaggggattgaagccccggccatccgaccgccgactgttgcagaaggagagagccggatcaggctgaccgtcaccgcagaacgcaggttgaaagatattgaagatctattagaggggtttaaattaatgggaagagagttgaacttggtgaaatgaagggtttttttgtaacgggaacagatacgggagtcgggaagacgtttatcgcttgcggtcttgccgctttactgaaagagcagcatgtagatgtcggcgtgtttaagccgtttttgagcggcgagctcgctagcgatccgcagagtgatacagctcttttaaagaacatgtctgaaacgcctcttactgatgaagaggttacgccttttatttttaaagagccgcttgcaccatacacagctgcgaagctcgaagggaggacagtcgggctggaagatgccgtgaaccattggaaaaagataaaggatcggcacgagtgcttcatcgttgaaggggcaggcggaattgctgtgccgctcggggaggattatttcgtcagcgacttgatcaaagcgctcgatttgccggccgtcattgtggcgcgtcccaatctcggaacgatcaaccatacgtatttaaccgcccaatacgcaaaacaaatggggatacgcgtgatcggcatcgtgatcaacggcatcagcagccggccgggacttgacgaacagacgaatccggacatgattgaaagattttgcggtgtaccgctcctcggcgttacaccgaagcttgaagacgcttcaccaacacaaattcaccacatgatcaaggatcatgtcgatgtttccttgattatgaatcaaatgcaaatgggggcagaaaaatgaatcagtggatggaacttgcagaacgtgtgctggatggcggggaagtaactgaaaaagaggcgctttccatcttggaatgcccggatgacgacgttcttctgcttatgcatgccgcttttcaaatcagaaaacgctactacggaaaaaaagtaaagctcaatatgattatgaatgcaaaatccggcctttgtccggaaaactgcggctactgctcgcagtcttcgatatcaaaagcgccgatcgacagctaccggatggtcgacaaaacgaccttgcttgaaggcgcaaagcgtgcgcacgatttaaatatcggaacatactgcatcgtggcgagcggcagaggaccgtccaacagagaagtcgatcaagtggtcgacgccgttaaagaaatcaaagaaacgtacggtttaaaaatctgcgcatgcctcggactgctaaagcccgggcaagccgagcggctgaaggaagccggagtagaccggtacaatcacaacatcaatacatcaaaaaccaaccattcaaatattacaacgtcccacacgtatgatgacagggtgaacactgtggaaacagccaaaaaatccgggatgtccccatgttcgggcgtcatcgtcgggatgaaagagacgaagcaggatgtcgttgatatggcgaaaagcttaaaggcgctggatgccgactcgattccagttaattttttgcatgcgatcgacgggactccgctggaaggggtcaatgaattgaatccgctttattgtttaaaggttttagctttgttccgctttatcaacccgacaaaggaaatccgcatttcaggggggcgcgaagtcaacctccgctccttgcagccgttggggctgtatgccgccaattcaatcttcgtcggagactatttaacgacggcaggacagaatgaaacagaggaccataagatgcttcatgatttagggttcgaagtcgaatcggtcgaagaaatgaaagccagtttacagcggtagcacgggggagatataacatgacgacagaactgcacgaggcagggccgagcctgaaatcggattcggatttttggagagatccatatctgttttacgatcagctgcggtccattcatcctgtatataaaggaaccgttttaaagcatccgggctggtatgtcaccggatatgaagaagcggcagcgattttgaaggaaccggcatttataaaccgcgttcctctcccagaagcttctactaaatatgaacaacttcagcgattgcagcgaaatatgatgctgtttcaaaatgagtccggccataagcggatgcggacgattgccggcaaagaattcatgccgcagaagacggcaactttccgccctgctatagaagaaaccgtccatgaattgctcgatcagcttgaaaacaagaagacggcggacatggtatcggaattcgcctttcctttggcaagccttatcattgccggcatgctcggcgtcccggaagaggaaaggtaccaattcaggcaatggacggcggatctcattcaaacgatcgatttgacccgtacacgaaaggtaatggcaaaaggcggtgataccgttgccaagctgacggcttattttaaaaatttaattgaaaagcgaaaagcgcatccttctgaagacctgatcagcacattcgccggtcatgagcagcttgctgatgaagaagtgcttgcgacgtgcatcctgcttgtgattgccggacatgagacgacagtcaaccttttgacgaacgggttgtttttgctcatgacacatcctgaccagctcagtgagctgaaagaaaatccgctgctgattgagtcggccgtcgaagaatgtcttcgctatgaaagcccgacacagctgacagcgcgcaccgcgtcggaggactgcgaaatcaacgggaaaatcatcaaaaaaggagagcacttatatatccttttaggcgccgccaaccgcgatccaaagatatttcaaaacccgcatctatttgacatcacaagaaagccgaatccgcaccttgcctttggagccggtgcgcacgtatgtttaggctcggcattggcgcggctcgaagcgcaaattgccattcccgcactgttggcgcggctgcctaacttgaagcttgcttcaacagacgttccatttcgcaggctaatcggctttagatcgctggccgagctgcctgtcatcctcaattaaagacgacgaaaaaaggggctggcttacaggtgccggccctttttaatctttcttttcattttgggtaatataggtttgcagaagcgcctttaattctttgacttctgcgcgcagttctttgatttcttttgtatcctctttcagctcgcctgtctcatcctctatttcctgagaaattttttgcgcattattcacgatttccccgacgatcaagttgatcataatgaaagtcgcaatgacgataaatgaaacgaaatagagccatgaccagccgctctcggcaaaaatgggcctgaatatgccgcttgcccacgattcgagcgtaaaggtttgaaacagtgtcagaaggctgagctgcaggttgccgaagtattccggcgcgatggcggagaagaacatcgtaccgatgacggcgtacacgtaaaaaatgatgctcatcaggataatgacgctgctgatggtcggaatcgccataaacagcgcgttgacgatccgtcttaatgaggggaccgaagtgatcgtccgcaggacccgcagcacccggaaaatacggagaacgctgacgaaattcgtattgtaaagaatcaaactgccggcgacgatcacgaagtcaaaaacgttccagttgtttttaaaaaagtgctgtttttgaacgaacagtttaagagaaagttcgattacaaatatcgttaaaaacaagcaatccacaataaaaaatactttttgataaggcttaaagaaagcgtaagtttccaaaccgatcgagatggcattcaacacaatgaccgtcgtgatgaatgactgaaacagccggcaattaatcaatgccgaaaccttgctttgaaccgaatatcgattttgatgagtgttcactcttgttatttgtcctcctgttttgatgtatttctatgatacgttacaacagcaggaagatgtcaagtcagttcctttatttttgcatcgaaaacttaacgtttacgtaaaagtataaaggtagtataatagaaaagaagaaaaatctcggggggatatggacgtggagtggatgaagattgatcaaatggccaagcgaagcggcctgacgaaaagaacgatccgcttttacgaagaaatcggtctgctttcttcaccgaagcggacggaaggcggagtccgtctttactctgaagacgatcttgaggaacttgaaagagtgatcagcgcgaaggaagtgctgggattctcgctgcaggagctccagcagttcatggaaacgggcaagcacctggagatgaataaagaaggatacctattgtcgctggataaacgggaacgaaaagaaaagcttgaagacattcagaggatgctgaatgaacagatgagaatgattgatgaaaagattgaaaaatttcaatcattcaagaagcgcttggaaggtatgcaggcaaaagccgagaatgccctacaatcaattgattaaacaagacaaacgctattttcatagcgtttctttatttggaaagaaggtttgatagataatgaatgaacaaccacctgagaactccagtatgtttaaacagccaaaagcggtctgggcggtagcctttgcctgcgtgatctcgtttatggggatcgggctcgtcgatccgattctgccggcgatcgcgcagcagctgcatgcttcccccagccaggtttcgcttttatttacaagctatctgttagtcacaggttttgccatgcttttatcaggcgctgtctcgagccggattggagcaaagctgacgttaatcagcggtttgatcctgatcatcgtctttgcgggcctgggcgggctctcgcattccatctctcagcttgtcggcttccgcggcggctggggactcggaaacgccatgtttatctccactgcgcttgccgtcattgtcagcgtggcttctggcggaagcgcaaaagccattattttgtatgaggctgctttgggattgggcatttcggttggaccgcttgccggcggagagcttggcacgatatcgtggagagcgccgtttttcggtgtatcggttttaatggccgctgctcttttggccatcttttttcttttgccgcctgtccaaaagccgcagaagaaaatttccgtcagtgcgccgatcaaagcgcttcgttataaagggctgttgacgctgtcaggagccgcattcttatataatttcggtttcttcaccctgcttgcatattcgccgtttgttcttgacttaaatgaacggggcctcggctatgtctttttcggctgggggctgtttcttgcgatcacttccgtttttatcgctccggccgtacagcggatcttcggaaccgtccgatctctgatccttctgtttatgctgtttgcagctgatttgctcgcgatcgggatttggacggagcacatggcgctcgtcatcggggcgatcatcatagccggaggtattcttggcatgatcaatacgattttgacaaccgcggtgatggaagccgcgcctgtcgaacggtctgttgcttcatctgcctacagctccatccggttcatcggcggggccattgcgccttggatcgccggtgtgttagccgatcattttactgcgcatactccatattttgcaggatgcatcgccgtgcttgccggcatcgccgtcttggctggaggccgccgttatttggcgggcatcaaagccggtcattaatgaaaaaagcttgtttccctaaaaggaaacaagcttttttgtttataaaactttcgttgtccatgactcgcaattccatgtttctgtcgctatgtccatatagaattcaggttcgtgagagatgagcaggacagagcctttgtattctttcaaagctctttttaattcttcttttgcttcaacatcaaggtggtttgtcggttcatcgagtacaagcagattcgtttctgaattgataagcttgcatagtctgacttttgctttttcccctccgcttaatacggaaaccctgctttcgatatgctttgtcgtcagcccgcacttcgccagggccgcgcggatttcgtactgtgtaaaggacgggaagtcgttccacacttcttctatgcatgtgttgttgttggtctctttgacttcctgctcgaaatagccgatatgaaggtgttcgccgcgttcgacttctcccgacagcggtgaaatttcccccaggaggcttttcagcaatgtcgtttttccaatgccgttggctccgtacagagcgattttttggccgcgctccattctcaagttcagcgggcgggacaacggctcatcatagccgatgacgagctccttcgtttcaaaaatcagctttccggatgttcttgcttgtttaaagtgaaattcaggcttcggtttttccgaagggagctcgatcatatccattttatcgagctttttttgccgtgacattgccatatttcttgtgctgacgcgcgctttgttgcgggcgacgaagtctttcagctctgaaatctcctgctgctgttttttgtaggcggcttcaagctgttgttttttcacttcatatacttcgcggaattggttgtagtcgccgacatagcgggtcagctcctggttttccacatggtagatcagattgatgacgctgtttaaaaacggaatgtcgtgagaaatcaaaataaaggcgttctcgcactcctgcaaatagcgtttcagccattcgatatgctgttcgtccagatagtttgtcggctcatcgagcagcaggatgtcgggcttttccaagagcagtttggcgagcagcacctttgtccgctgaccgccgctcaattccgcgacatccctgtcaagtccgagatcgttgagcccgaggccgcgggcgatttcttcaacttttgcgtcaatcgcgtaaaagtcgttgttggtcagggcgtcctgaatcgttccgacttcttcgagaagcttttcaagctcgtcggggtcggcctcgcccatttttgtgtagatggcattcacttcttcttccatcgcaaataaataatggaaagcgtttctcagcacatcgcggatcgtttgtccgcgctcaagcgatgtatgctggtcaagatagccgacccggacgttttttgaccattctacttttccttcgtcaggctcaagtttgcccgtaatgatattcatgaaggtcgattttccttcgccgtttgctccgatgagaccgacatgttcgcctttcagcaagcgaaaggatatatcatgaaagatcgcccggtcgccaaaaccgtggctcagctttgtaactgtaagtaaactcatgttttgcacctcaagaaatataatctgtattctataagattatatcgaactcggagggaacaataaaagaaaaattgcgaagccgcttttgttttgagatactaggagcagaatcaacctgataaaaggagaaaaacatgacagaaagatggccatttttaaataaagcaaaaccgtttattcaagaaaactggaaggcgtcgggctttcaagatccgacgaatgtccaaaaaaacgcggtcgatctgattttggacgggcgtgacgtgatcgccgagtcgccgactggaacgggcaaaacgctcgcatacgtcctgccgattctggaaaagctggaggcggatcaaaagaacgtgcaagctgtgattctggctccatcccgcgagcttgtcatgcagatttttgatgtgatcgttgaatggaaaaaaggctctgatatcagagccgcttccctgatcggcggcgccaatatcaaaaagcagcaggaaaagctgaaaaaacacccgcacatcattgcaggtacgcctggacgcgtatttgagctgattaaaatgaaaaagctgaaaatgcacgaagtgaaaacgatcgtccttgacgaaaccgatcatctgcttacgccggagcaccgcgggacgatacaaagcatcatcaaatcgacgctccgcgacaggcagctcctctgtttttcggcgactttaaaagacgatgccgaacgcgagcttcgtgaaatgaccaaggatgcggaagttctcaagatcaagaggtcgaaagaagaatcggcaaaagtcaaacatcaatttctcgtatgcgaccagcgggataaggtgaaaattctgcagaaattctctcggcttccaggcatgcaggcgctcgtctttgttaaagacatcggcaatttaaacgtatatgccgaaaagctcaaatttcatcatgtagaaatcggcgtccttcacagcgaggcgaaaaaaattgagcgcgccaaaatattgcaggcatttgaggcgggagagttcacactgcttctcgcgaccgatatcgcagcgcgcgggatcgacatcgaagatctcccttatgtcatccacgccgatttgccaaacgttgaaggctatatccaccggtcgggaaggacgggaagagcggggaatgaaggaaccgtgatcagccttgtcaaccgcattgaagaagaaaggctgaaaaagctggcgaagaagcttgaaattccgcttcagcggatcgtgtatgaaagaggacggattattgaaagataagaaaagaggcctgccgccggcaggcctctttttatatgaatgctcaggcattgtcggaatcggcgactttgatcagctgcttgccgaggttttttccttcaaacaagcctaaaaatgcctcaggtatccgctcgaaaccttctgttatcgtttcctcatattgaagctgtccgcttttcacccattcggcgagctgtttgattccttcaggaaagcggtccctgtaatcgtttacgacaaatcccttcatcagggcgcttgatttaatcaaggccgtttgtacgcgcggtcccatatcttcttctgcgcttttgacgttataagaagaaatcgccccgcagactggaattcgtgcaaacttattgatcagggtgaagacggcatctgaaatcgcgccaccgacgttgtcaaagtaaacatcgacaccgtccgggcaagcttgttcaagcgctgaagccatattttccgttgttttataattgattgcttcatcaaaaccgagcttttcttttaaatatgccgttttttcatcagagcccgcaattccgacgactcttgcccctttgattttggcgatttgtccgacggcggagccgactgctccggcggccccggagacaacaaccgtttcaccggcttttggctgtccgatgtccagaagtccgaaataggccgtcaaaccggtcatgccgagaattccaagaaaagcggtaacaggcgcgagggacggatcgattttctgcagattgtcttcgcgaaccgctgaatactcctgccagcccaagcggcccaaaacaatatccccttttttgagcttgtctccttttgcagatatcacttcgccgatcacgcccccggtgatcacttcatcaagcggaaatggctcgacataggatttcgtatcctgcattcttcccctcatataagggtccactgagacataaagcgtttttacaagcgcttcaccgttttttgcttccggaatttccgtttcttttatgcggaaatcgtccataacaggtatgccctgcggacgtcttgcaagttcaatttgcttttgcggcataatgattcctccttttacttataacttaccacgtaaaaaagaggtttagcaaaagatcagcggattgcacgaaatgttttcttcagtacagaatcgggcagaaaaaggtgaaaaacatcggcatttctttcatttaaaagatattgattggcattttctcttgaatattggaacatgtcttttgtgataaaaggaagcaatgacaggagataagaagagaggaggtcttcggtgctgcttgccgttctcctttcttccggatcgccgatgttcatgatgatcgaaaagacataatcgatattgatgccgaatcgtctggcggcaaatgattcaaatcgatgagtatcagcttcctgatgaccctctcttgaaaaaatctgcttgaccaaatcgctaatgatccatgcgttgtattgctgttccggtgaaaaataatacacgctaaatcaccccatctaaaagccttgtctatttgttaatgtacctgaattggcaaccctttcaaacattttgtctgaaaatttataacaattgtaacattgaaatgaaaatgtcatgacagagcattcctccgtttagccgtgtgaacaaagggtaagttttaaatacaacatgaaaaagggaggagattcatatgaaaccagtagtaagacaatatacaaacgatgaaaaactgatgaaggatgttgaggaactcagggaaatcggagttgcaagagaagatatttacgttttgtcacatgacgacgaccgtactgaaagacttgcagacaacgcggatgccaatacgattggagccgaagagacaggcatcaaaaatgccgtcggcaatatcttcaacaaaaaaggggacgagctccgcaataaaattcatgagatcggcttttcaaaacaagaagcagaacaattcgagaaacagcttgatgaaggaaaagtcctcctcttcgttacggatcatgaaaaagtgaaatcctgggtataatttgcaactgccgacatggtcggcagtttttttaataaaataaaatttgaatgatagcttgaaaggagtagaataataaacgaaaacgatatgaataggaggaaaagctgtggctaaagaaaaagatgcagaacaaaaatcggcactgaacatcattcctcttgcggtcacgattttagtcggagcggttatttggtttattccgtcgcccgccggattggacccgaaagcatggcacttatttgcaatctttgtggcaacgattatcggctttatatcaaaaccgctgccgatgggggcaatcgccgtattcgcattggcgatcacggcgctcactggaacgctgtcgattgaagaaacgctcagcgggtttggaaacaagacgatttggctgatcgtcattgccttttttatttcgcggggatttattaaaaccggtttaggtgcgcgaatcgcctatttatttgtacggatgttcggcaaaaaaacactcggactctcgtattcactccttgtcagcgatttgattttatcgccggcgatcccgagtaataccgcacgtgccgggggaattatttttccgattatccgttcgttatccgaaacttttcagtcgacgcccaaggacggcacggaacggcgcatcggcgctttcttgctgaaggtgggctttcaggggaacttgatcacttctgcgatgttcttaacggctatggcggcaaacccgctgattgccaaacttgcccatgatgtggcaggtgtgaatctgacctggacaagctgggctgtggcggccatcgtcccgggacttgtcagcttgatcatcaccccgcttgtcatttataaactgtatccacctgaggtgaaagaaacgcctgatgcggcgaaaatcgcaacagagaagctcaaagaaatgggcccgttcaaaaaatcggaactctctatggtcgcggtctttttgctcgtcctttttttatggattttcggaggcaacctgaatattgacgcgacaacaacggcattgatcggtttagccgtcctgcttttgacacaggttctgacgtgggacgatattaagaaagagcaaggcgcatgggatacgctgacatggtttgccgcgctcgtcatgctggcgagcttcttgaatgaactcggcatggtcggctggttcagcgatgcgatgaaatcgtatgtttcaggattctcctggatcagcgcatttctcattttaattgcggtttactattattcgcattatttctttgcgagtgcaaccgctcatatcagcgcgatgtattcggcctttctcgccgtgattatcgctgcaggcgctccgccgcttctcgcagcattaagccttgcgtttttcagcaacctttttgcttcgacaacgcattacggagcgggagcggctcccgtctttttcggggccggctatattccgcaaagcaaatggtggtcaatcggcttcatcttgtcgattgttcatattgtgacatggcttgttgtcggagggttatggtggaaattactgggcatatggtaaaatgaagggcgggagagatcctgtccttctttttatgttcatatcgacgctgttgatttgaaattccacgatttgtagtctagaaagggtttgtttaaatacaccgaacgtaagggggtgaacgttaatgttttggtcagttgatttcatgctgctcggtttcttgtatgcgatcgtctactttttgtacgacattgtgaaaaaccgaaaaaagacaagtttttttagaaaaatagtgtttgccagttttattgtttatttgagcgccgtttatcactatacgataggcggaatcaacattccgccgcagccggcatacgctcaaatgaacattcagctcattccgttttattttgtcactgaatgggtgcaaatgtatcagcagagcggctttgattgtttttttggaattccgtcaagcttacattttttaatgttttattgctcattcctttaggtgtgtatctttccgttctatggagaaaaacttcgcttaaaaaagcggcagtttttgtttttttgacgagctttttgattgagagtctccagcttgtgctgtctgtgacaggattaataatggcgagaacctttaatgtggatgatttaattttaaatacggccggcggtgtaatcggtttctgcctgacgtctttcatgttcggagctaaaggatcagattcccgcaggaaaggtctgcatttttgaagaaagcgcgaaagttggttcccggctaggcaatcatcttttttagttaaaattgaaagctcaggctcttaaatcggtgcatgcctgtgccgtgctgtgccagtccgtgtttcttcaagtgccgtgccgcatgtccggcttcctctaaaatgtcaggagcaagaccgagctgatgatgcccgccgaaaaccttttttacgcgcccgatagccgaaactttttcaagcgactgaaccagttgagccggatcagtcgtcggatagaatgcatagattggagctccggtatacagcagatcgccggtaaacaagtagcctgacgctggatcaaagatgcaaatatgccccggggagtgtccaggcgtatgataaataacaagcggccttgagtcgcagccgaccgtatctccgtcttgcagcgttcccgacggttcgcctctgaacggggtgtatgtttcagcggaaaagccggccggaacaggcttggtgatatctctcgagacatcgcggcgaatttgctcgatcggaagtcctttgattccgtccgtcagccattctctctcagcttcatggacgtaaatgcgctgatattcatcgtggcttccgatgtgatcccaatggacatgggttgtgatgacgctgaccggcagatcggtcagaccgtccgtcaccgtcttcatgctgccgatgccaagacccgtatcaattaaaacggcatccttcgcccctataagcaaataagagtgtactttttcccaatgcccgtattcgctgatcgcatatgtggattcatcaagctctgtcacagtaaaccactgactatctgccattggtttgtccctccttcatttttttcaaaggtgctcatcgatgcatatctcccagtcaaatgtgcaaaataataaaatacataataggtgagagtggtgaacatgatgagtgatccttacatgcctttgacatccgttaacagcggggtcctggaggagtatgccgaaggtgtatttggtttgacggtgcaaatcgtcaatgtgtattttattttcgatcccgattcgcgggaagccgttttaatcgatgccggtatgcccaagtccgctccattcattttaagagaggcgaaagagcggtttggcgattttcggcttaaaggaatcgttttgacacacggacatttcgaccatgtcggcgctttggaaagtcttctcgaaacatggccggttccagtttacgcccatgagaaagaaatgccttatttaatgggaaaagccgattatccgcctgcaaaaccgcaagtgaaaagcgggctggttgcaaagatgtctccgttatttccgaggcactccatcaacatttcgttccatgtaaagcagcttaataaagatggttcgcttccgtttcttgaaggatggaaatggattgagacgccgggccatacaccggggcatgtttcgcttttccggcagtcggacagaaccttgatcgcaggggacgccgttacaactgttgagcaggagtctctatttgaagtggcaattcaaaagcaggagctgaacggaccgccggcttatttcacaatggattggacaaaagcagcagattcggttcggaagctggcaggattaaaaccggctgcattattgacgggacacggtgtaccgatgaaaggaagcgatttttccgaagcgctccttgatctatcagaccgcttgcccgcctctgattcgtaaattgtcatatgctgcgcttaaaacattcagccaggctgaatgtttttttatagggaaaaactaaccattttacatgtgatgatggccgtccattgttctaaattccggatgttgatgtataccaaaggaatcattttctgaaattttagacaaaatatgttgatatttcatttataatgcaggtatgcctgaaaggagctgagaaaagatgaaaattcaaaaaagggtccaagctttgctggcaacttcggcaatgtttgcaggactgatgctgtccgatgcggtgtacgctgcggaaaccccttactatggaaagaactatactcagccagagcaagtgtcatcattatatccggagcctgaagaaacattctcaacccctgcttttgtaaaagaaggggaagcctttacgacacaagaagaaatgatgaagtttataaccagtctgacaaagaaaagcccgaatgtcaaaatcgggaatatcggtttttcaattgaaaaaagaaatattcctgtgctttacttcacaaaggacaagcaaatacgttccatatcaaaaaaaccaaccgtctggctgcaaggacagatacatggaaatgagccggcagcgggagaatctgctctggcgatagctgaaaaactggccggaccgtatggcgacaaagtgttggacaagatcaatgtcatcgttgttccgcgggtcaatcctgacggatcatatcagttcaacagacggctggcgaacggaatcgacggaaacagggatcatgtcaagctcgagtctccagaagtgcgcgccattcaccaagaattcaataagtattcgcctgaagtcgttatcgatgcccatgaatacggtgtcggccaaaacgaatttcagagcataggcgaaaaagggtcattaaaataccatgatattttaattttatcaggaaaaaatttaaacattcccaagtcgatcaggcatgcgtccgacagcctttatgtgaacggcgtcagagctaaacttgatgaaaaaggattttctaatgatgcttattatacgacaggaaaaagcaaggacggaaaaatcgaaatctatgaaggcggtacagaagcgagaatcgggcgtaatgcattcgccctccagcctgccctttccttcctggtggaaagcaggggaatagacatcggacgcgaaaattttgcaagaagagtcgcggctcaggttgctacacatgagacgatcatcgacacgacagtgaagcatgcagccgagatcaagcgccttgtctccaaagaaaaattaaagctgatacaaaacggcgctaaagtgagcgataaagaccaagtggtcatcaacagtgagtttgcaggcccgtttaaagacacgcttaaagtcgctgatattgcctcaggacaagcagttgacgttcctgtccaatattacagcgcctcagaggccgttcctgtgctgtcaagaactcggccgaccgcttaccttgtccttccgggccatcaagatatcgaacagaagctgaaggatcagggattaaagagcgtgacactggctttcaaacaaaaactcaccgctgaagcgtatgaggttttatcgaaagaaacagcgggagaatctgagggccggccagtgatcaaggtagaaacgaagctcaaaaaacagaaaaaagagtttcctaaaggaacaaaaatctattttacagctcagcagcaaagcaatctgctgtcaatcgcacttgagccggagtcggttgacagttatgtaagcacaggttacattccttctcaaaaaggcaaagagctgccggtttaccgcttcatgctgaacaccaaaacgcttaattttaaggaataatcaccaggcatccgtctttgacggatgctttttagcggttttttgttttttcatacataattgttttaaactgagatcgaaacctatacaataaatatcagtctgaaatctggaaggagagaatccggttggaatcacatgaagaattatggagggaagccaaggccttcatcgagctctgctacggggaactgtcgaagtccgaagaagaaacaaggatgcgcttacataaaatagataaagaaatcagagaaaccggaagctatacacatacattagaagaaatcgaacatggagccagaatggcgtggagaaacagcagccgctgcatcggcaggctgttttggcactctcttactgtcatcgatcaaagaggcgttcaaaccgaggcagaggtgcgggatgcgcttttccaccatattcagcttgcaacaaacggagggaaaatcagaccgttcattacggttttccccccggaacaaaacggacaaaaaaaagtgtccatttggaaccaccagctgatcaggtatgcggggtatgaaactgagcaaggcgttatcggcgatccggcgtcattggaactgacaaaggcgtgtgaagcgctcggctggaaaggcgaaggtacgccttttgacgtattgccgcttgtttttcaaatagatgggcgtcctcctgtgtggtatgagctgcctcgtgaaatcgtcaaagaggttcggattgaacatccggagattgaaggcttcaaaagtttggggctgaagtggtacgctgtaccgattatagccgatatgaagctggaagtcggagggattcattataatgccgccccgtttaacggctggtatatgggaactgaaatcggagcgcgcaacctcgcggatgcagaccgctataatgcgctcgaaaaagtggcagccattatggggcttgatacggagcggaatacttcgctgtggaaagacaaggcgcttgttgaattaaatactgcggtgcttcactcctataaaaaagccggcgtcagcatcgtcgaccaccatactgcggcaagccaattcaagcggttcgaggagcaggaggctgaagccggaagggagcttgcagcaagctggacgtggctgattccgccgttatcgccggcagcgacccatatctttcacagctattatgaaaataaaacgctgaaaccgaattacttttatcaggaaaagccttaccttaacaaataaaatcctcaggaaaagcggctacccaacaatgccgccttttctgaggagaagctaaaaggctccaaatcggagcctttttgaatcgtctcagcttttcatattgatttccttccggtacaaaacataagaataaatatagggcgccaaaaccgttgccaaaataaccggaagcatgatttctggactgattgataacaacccgtccgcagctattagaagtcctgccaaagtaaatactttcgccgcaaatctgtgggtttttttccagattgaatcactgctcaatgtccaagggttcttgatcccgaaaaaaaagttggagcggactctcggtaggtaattgcctatgacgattaatagagcgcctacaagaaccggtacgatgctgcccgccggcagatcatacccgagcccggtcatgataacaagcacgttgatcagagaaaatataagcagcatggcattgatgagaatgtaataagtcttcgaaaaaagctgatagttttttctgcgcggatcgattttcggcgttaagaacatcaagacatatacaaaaacgagcagcccaatcatggcaagcatcgcttccattttggaagcatacctgtcgatttcccccgaagatgaccaatggattggaacttgaccggaaatgtgcggataagcgattgcccacatgattagattcatagcgattatagcgagcgaaaaaatgtgttttctcattttgcatcccctttatctttgccggcttgttcagtaaaactgaaagcccagccgatgatttcttgaaacattgtagtgtttagcgagtagatgatgtattggccttttttttcatcctgaattaattcagcctgttttaaaatttttaaatgctgagaaatacttggtttagacatttgaaactggtcggaaatttcaccggcggtcatatcccggtccttcagcaggttcaaaatctttcttctcgtcggatcagctagagctttaaaggtttgattcatatttagcatccttagaataagtatttagttatttaactaaatactaaaataaaagaaaaatttagtcaagatttattaaaaaaatccgccatctccggcggatttctcaatagctgatattaaacttttggaatccgtccaattctttggtttcttccacttttacatccgttacttttgagaatggacttcctttttgaattgcttttaaaaattgcttcaggctttcctcaagtccctcggcgcggatttcaactgtgccgtcgtcgcggtttcgaacccagcctgtcaatttgtgtttatctgcttccatttgaacaaaatagcgaaatcccacgccctgaacgcgtccgtctacaatgattctgtattgaagcatcgagaacaccccttttcttttatgctaccatatttcccattttgagatcatgggatagacatgcttcggatgaatcgttaaaatatgaaaataaaggaagggcgtgaggttttggaaaatcaggagtatgaaatcatatctattcatgtaggccgtccgcgtacatacgaattcgacggtaagcaggtggaaacggcaatcgtgaaggagcctgtcagcggacctgtctatttgagccgtacgaattttgaaggggacgggcaggcggatctgattcaccacgggggagaggataaagcggtttgcgtctatccggcggatcactacatgtattgggaaagcgtcttgaagcgaaagctgccagaggcggcatttggagaaaacgtgacagttaaagggctcaccgaaaaagaagtgtgcatcggcgatatctttaagctgggggaagctcttgttcaagtcagccagccgcgccagccttgtttcaagctggccaaacgtctgaatcaaaaagatatggtgttaaaagtgagggacaccgggtacagcggattctatttcagggttctcgaagaaggaattgttgcgcctgattcgcggctgcagctcgtttcaagagatgcgcatgaagccacggtctcgtatgccaatcatttgatgtaccatgacatgggcaatcacccagccattcggaagatccttgaggttgaagcgctgtcggaaagctggagaagctcatttttaaagcagctgagcgcataaaaacaagccgtgtctgaagaggaatacggctttcagcgtgtcgacaaaccctcgcattcgttgtcaggcctgctaagtcggtgctcacgaatagaggaaggatcggcggctaaccgccaggcgtcctgcctgaacgccgccgtaatcacctcctgtgaaagtctgcttcgatgctcggccttcctagactgcaagggttgcgggtcacgctgagcttaaaggatgtttattttttgacgctttcaagcaggttggccaaaaagtgttttttatagctttgaagctttcttccttcatacttcgtcattcccagctttttcagttcttctacataccagcctttgcttccgtaatgcatggcagaaaactcccttctatatttcgatgcaattgggattctaacatctatagaaaaacgctgaaaagggataggcggcaatttttaaaaactgagtctttcgacatagtctggaagtttgagggcaggcgtcagccgtgtgtcaaactggtgacgatcatcacaatgatcgcgatgctgaggacgatcccaatatattttaagaagccgttcttttttttatgagcatatacgattaacaggatgctctcgataaaaaagatcagcccgatgatggcaaacagcatgcggtaaagctcctttcggcacagtttgtcttttattttagcataaaagcccgcgcttctatgagccgggcttttttatgcgtaatcagtcaagctgtgttaaaatgatcggttcgtttttcgtgatgacgatcgtatgctcgatctgcgccacaaagctgccgtcaggcgttttgaatgtccagccgtctccggcttcgatggtatgttctgcttttgtggaaacaaacggctcaagggcgatgacggttccgtttttaaagagcgcattatcaaacgggtcatagtaatttaagatatggttgggcgcttcatggaggttccttccaatcccgtgtcccgtcaggtttttaatgacggtaaatccgtttgcttttgcttcattgtatacggctctgccgatttggttttgtttcttgccggcgcgcgcctgcaaaagccccttttgaaaagcgctttccgcactttggcaaagcttgtgcagcatttcatcgccttttccgagtacaaaagaaatgcccgtatcagaatagtagccgccaaattcagcggagatgtcgatgttgatcaaatccccttcttttaaaattctggattcgcttgggatgccgtgggcgacttcatcgttcacactgatgcacgtcgttcccgggaagtcgtattctttttccggagccgatgcggcgccatgggcttcaagcacttcttttccgatgagatccagctcttttgtgctcatgccgggagctgcttttgccttcatttcctccctggctaaagcgacgattctgccgattttcttgagcccttccagctcttggtcattcgttacaatcacaattcattcccgctttctttttttatattccatttcaagcttaccatatttgtttgcgaaaaaggaacagagcggcttcaagacaaaaaaagcacccgcttatttagaagcgggtgctgtctgtttattgtccggaatccgatttcgttgtttgcgccgcatcagattctgatgttttcggattgtggttggtatagtcgtagtcgctcggattgatcgctttaaagcccttcggtttatagaagcgcagcaaatctccgtcgacgattttatccgacatttcgagttcttttttcacggcctcttcgatgttcggatcgatgtctttttcgttcagtagctctcctgttttcgtgtcatagtagtttccgttcgttttcgtatattccggagagacgaaatcgccgttgcggaacggaataatttcacggtgttccggtgacagaaggtctgaaccgctcatcaggtaatctttcgtattcacgcccatcaaatgaagcagggtaggggctacatcgacttcgccgccgtatttatgggatttgattcccttgaccccaggcgcgtggatgaacagcggcaccctttgcaattgggcgttttcatatggtgtgatgtctttgcccaaaactttggccatcgctttgttgtgattttcagaaataccgtagtggtccccgtacatgacgacaatcgtattatcatacagtccggcttttttcaggtcgttgaagaattgttcaagcgcctggtccatgtagttggccgactggaaataatggtcaacgacgctgtcgccggtatccccggcagggaagtctgtatcgccttcatccatctcgaacggaaaatggttcgaaagggtgataaacttcgtatagaacggctgtttcaggcttttcaacagcggcattgattcttcaaagaacggtttatctttcaacccgtagtttttcgttttatcttcgctcatatcgtaatacgtagcgtcaaagaatttgtcataaccgatggctttatacatttcattgcggttccagaacgttttgtagttgccgtggaacgccgctgatgtatagccttgagacttcaaaatggccggagccgactgcagcgtgttttgcgctttattaatgaacactgacccttgcgataaaggatacagcgagttgtccatcataaattcggcgtcggacgttttaccttgtccggtttggtggaaaaagttatcgaaataaaacgtttcattgtcgtgcgccagtgaatttaagaatggcgtgacttctttgccgtcgagcttataatcgatcaggaaggtctgaagtgattccagtgaaatgtaaaccacgttcatgcctttcgcttttccgaagtattcggcattcggcttatcatgattggctttaatatagttctcaacttccgttacgtcgctggaacttgccagtgcgcgctggctgtttgacttgatattttgcaccgcatcatagattgtgaagttgtaggttcccaaatatttcacaaggtagttgcggtcaaaagaacgggtcagaagctccggacgatcgatctcggcaacggccaggttggcgaggaagacgaggatgcttgctcccatcacaattttaaacggacgcttcgttgttgtttcagatggtctgttatagaaaacagccagcccgattaaaataaaggtgtcgatgaaatacagaacatcaagcgggtgcataagcgagaagatgctgtccccgagctgtcctccgtttgtttttgcctgcatgattgcaggcagcgtgataaagtcgctgaaaaatctgtagtatacaacgttcgcatatagcaaaaaagacattaaaaaatgaatcactataatcgctgtctgctgtatttttttcttgaacaagagtcccaatccaagaaagaacaagcttgagctaatcggattcacaaaaagcaaaatgtgttgtactgtgttggttattcctaaattaaattcaattacatacgcagcataagtttttagccatagcaatatagcggctatcaggaagaaggcaaggcctctttccttaataaatcttttcaattgttacactccttttttccggatcagtaaaaaccatcggaacgaaagaaaaaaacgaatgtataaaatataccatgaaataccgatttagaaaagcggaaaccggccttgcgaaaaaaatcgcaaaacccctgtcaaatcagggttttacagctttaaaaaagatgtttgggaatattttacgcttgtattgcattggcgggaactgatctttatggcagactgttgttagtatatgaacgaaaagggaggatttagaccatggatttttcgagcatcgtttctgaagacaagattaagcaggccattaaggacggcgaattcgaagggcttccgggaatggggaaacctttgaaaaaagacgatgccgcccatgttccagagcatctccgcatggcttacagagtgatgaaaaacgccggaatggcgggggatgaaggcgctttaaagaaagaactgatgacgattgacgacttaatcgcaaagtgcgcggatgaagacgagcgcgagcgtttaattgagagaaaaacagaaacccggctcaggctcgacaggctcgccgacaaaaaaggcatgttttccaagcctgcctcagcgttttataaagaaaaagtgtaccgaaggctgagcggaaataaaaagcgctaaaagcaggtttatttctcccctgtagtggtattgacccgtaaacgaacaaaagggtgataggatggaacgattattgaattgggttgaatacatatcagattggctgtgggggccaccgctgatcatactgctgacagggacaggagtctacttgacgatcctgctgaaattttttcaatttcgctatcctctctatatctttaagcagacgatcggaagtgtcggcaaaaagccgaaaggagaagggacggttacaccgctgcaggctttgacatcggctctcagctcaacagtcggcgccgccaatatcgtcggtgtgcctgcggccatcatgttcggcggtccgggagccgttttttggatgtggctggtcgcgctgtttgccatggcgatcaagttttcggaaagcgtcctcgccgtccactacagagaaaaaaatgaagagggcgaatatgtcgggggaccgatgtattacattacaaaagggctctccatgaaatggctcggcgtctttttttcagtagcgctgatgatcgaacttgtaccgagcatcatggtgcagggaaattcggtttccgcatcgctggctgagacgttctcgttcaatcgtttatacaccggaatcgggattgcttttttgatcggtttagtggtgatcggagggattaaacggattggaaaagtgacggagctcgcagttccgcttatggcaggggcgtacatcggggccggtttcctgattgtcgtcacaaacctttcctctgtacccgcttttttctctctcatctttttgaatgcgtttacatcttcttcggcattcggcggctttgcaggtgcggcagttgccgaaaccgttcgctgggggtttgcacgaggcctttattccaacgaagccgggatggggacggcgccgattgcccacgcagcggcgatgaccgaccaccctgtgagacaggggttctgggcggtgatcggcatcgtggtcgatacgctgctgatttgcacgaccaccgccttcgtcgtgctcgcatcaggcgtctggaccggcgaaaacgcatcaagcgatccgggggcgctggccgcagccgcatttcgcagctattttggccctgtgggcggatacttcgtctctgtctcgctcgttttctttgtcttatcaacgatcacagtagtcattttttacggtgtaaaacaagctgaatttctgttcggacggctcgcgggacatgtgattaaattcatctacctggccgccgtcgtcatcggtgctgccggaggagcaaaggcgatatggggattcctcgatctcgcgctcgttttcattcttcttccgaatattttggcggtgctgctcttgagcagaaaagtaaggtctttatatgatgagttttttacatcagaaaagtattatttgaaagacatcggtcagcaggacggcgtttatgaaggtgacgaaaaagtgaacaatttatgatcacagccggtttgttcccggctcataaatcggaggaagccttgctctcctacgttttatgaagggaacatccggctttttttaatttttgaaagcgctacaaaaatatattgactacttgtatatacaggaatacaatatacctataacgtgtatatacaggttataagaggagaaggagggattggaatgactgatttgaatcaatcagcgcgacggattgtcgatgctgtcggcggtgctgacaacattgcagcggtaacccattgtgtaacgcgtttgcgatttgcattgctcgatgaaagcaaagtcaatcaagaggtgctggagcaaatagatgttgtcaaaggatcgttttcgactaacggccaatttcaagtggtgatcggccaaggaacggtcaacaatgtgtacgcggagctggtgaaggcaacaggaatcggcgaatcgtcaaaggatgatgttaagaaagcctcagagaaaaatatgaatcctttacagcgtgccgtgaaaacgcttgcagatatatttattccaatattgccggcgattgtcactgccgggctgctgatggggatcaacaatatcctgacggctcaagacattttcttcagcggaaaatcaatcgttgaagtctatccgcaatgggcggatctcgctaatatgattaacttgatcgcggggactgctttcgcatttctccctgcgctaatcggctggtcggccgtcaagcggtttggcggaaatccgctgctcggcatcgtgctcggcgtcatgcttgtgcaccctgatttgttaaacgcctggggatacggggctgcggagcaaagcggagagattcctgtctggaatttattcggtttggaagtgcagaaggtcggctaccaggggcaggtgcttcccattttgctcgcttcttatttgctggcaaaaattgagcgctttttgacaaagcggacgcctgagagcattcagctccttgttgtggcaccgattacgctgcttgtcacaggttttgcttcatttattgtcattggaccgattacatttgccatcggaaatgttttaacatcaggccttattgctgtctttgaacaattcgccgtactgggcggactgttatacggagggctttacgccgctctcgtcattaccggaatgcatcatacattccttgccgttgaccttcagctgatcggctcaaagctcggcggaacatttttatggccgatgctcgcgctgtccaatattgcacaaggttcagccgcgcttgcgatgatgtttattgtcaaagatgagaagcagaaaggcctgtccctgacatccggaatttcagcttatctcggaattaccgaaccggcattgttcggagtgaatctcagatacagatttccgttcgtgatcgcgatgatcagttcggggattgccggtatgttcatttcctcgcaaggggttttggcaagctctgtcggcgtcggcggcgtacctggaattttctctattatgagccaatactggggagcgtttgcgatcggaatggcgatcgtgttgatcgcgccgtttgccggaacatatctctacgcaaaattaaaaatgaaataagagagggagaggggcgcgcatatttgtctgcccttttcccattttcataaagaagaaagcggtggtgttgaaaatggaaacgaaagaaaatccatggtggaaaaaagcagtcgtctaccaaatttatccgaaaagctttaaagatacaacaggaaacggtgtcggcgacatacgcggcatcatcgaaaagctcgactacatcaaggagctcgcctgtgatgtcatttggctgacgccgatttatcaatcgccgcaaaacgacaacggctatgacatcagcgactattacagcatccatgaagaatatggaacaatggccgactttgaagagcttcttgaagaggcccacaagcgcggcataaaggtgatcatggatcttgtcgtcaaccatacatcaacagagcacagatggtttaaagaagcggcgtccggcaaagaaaatctgtaccgcgacttttatatttggaaagacatgaagccgaacggcgctccgccgacaaattgggaatcgaaattcggcggctcggcgtgggagtttcatgcagagagcggacagtattatctccatctctatgatgtgacacaggcggatttgaattgggagaatgaagcagtcagaaaaaaagtgtacgagatgatgcatttctggtttgaaaaaggaatcgacggcttcagacttgatgtcatcaatgtcatctcaaaagaccagcgtttccctgatgatgacgagggggacggacgcagattttatacggacgggccgagggttcacgagtttttgaatgaaatgaacagggaggttttttcaaaatatgacagcatgacggtcggagaaatgtcatcgactacaatcgcagattgcatccggtatacaaaccccgaaagccgtgagctcgatatggtgtttaactttcatcatttaaaggccgactatccaaacggggaaaaatgggcgcttgcggattttgattttctaaagctgaagaagattctttctgaatggcagacggaaatgaataaagggggcggatggaacgcattgttctggtgcaaccacgaccagccgcggatcgtctcacggtacggggacgacggaaaataccgcaaaaagtctgcgaaaatgctggcaaccgcgattcatatgcttcagggaacgccatacatttaccagggagaagagcttgggatgaccaacccgaaattcgatgacatctccctttacagggatgtcgaatctctcaatatgtaccgtatcctgaaagaagcagggaagccggaagccgaaatcatcgaaatcttgaaagcgaaatcccgtgataattcgcggacgccggtgcagtggaacagagaagaaaatgccgggtttacggcgggcacaccgtggattccggtgcctgacaactacaaagaaatcaacgcagaagaagcgctcaacgatcctgattcgattttctaccattataaaaagctgaatgagctccgcaaggaattcgatatcattacaaccggcgattatcagctcatactggaagacgatcaagagctttacgcgtatttgagaaacggagcggatgaaaaactgctggtgatcaataatttttacgggaaagagaccgagtttcagctgcctgacgatattgatattgaaggctatgatgccaaggttctcatttccaatgacaccgatcttcccgagtcatttaaacgcttcacagtgaaaccatatcaatcgattgtttatcatcttgccaaaccatgctaaactaagcgtggtggtaaaaaaatgaagatcaacaagtatatgatgatttacaaacaaatcgcggaacaaatcgatcaaagcatactgaatgccggagatatcctgccgtctgaaaacgaccttgccgaacagcacgacacctcgagggaaaccgttcggaaagcgctgaacgtgcttgctcagaacggatatattcagaagattaaagggaaggggtcagtcgtgctgcacagggagaaaatgcagttcccggtttccggtttggtcagctttaaggagctttcagaaacgctcggaaaagagacaagcacgacggtccatgagttcggcttgacgcatccggacgcatatattcaaaagcagctccgcacttccggagatgaagaggtatggcgggttgtcaggtcgcggaacatcaacggagagcgtatcatcctggataaagactatcttatccgcaaacacgtgccgcttttaacgaaagaaatatgcgaggactcgatctatcaataccttgaagatgaatgcgggctcgtcatcagctatgctcataaggaaattgtagtcgagccatgtacggcagaggatcaagagtatttggatctgaacggatacgagcacattgtggtcgtgaaaaatttcgtttttcttgatgatacgaccttgtttcaatatacggaaagcagacaccgccttgataaattccggtttgtcgattttgcaagaagagaaaagtagcacggttcgcctgacggcggccgtgtttttttatgaagccgtttctcattacgtccgcattgaatatgctacagcaggtgtaaatgagaaatggaggatgtaagcaatgattcatgaaactgcaaagatcggaaagaacgtggtattgggagagcatgccgttattgaagaaaatgtggtcatcggggacaacgtaacaatcggccatcatgccattattaaaaaggacactcatatcggcagcggggtgaaaatcggcgatttggccgtccttggcaaagcggcttcttcaaataaaaaaatggctcgccagccgaagcaggcaggagcccctttgcggatagaagatgatgccatagttggagcaagcgctgtgatttaccgagacgtgctgttggaacaaggcgtcttcgtgggggatatggcgagcattcgcgaaaatgtcgcgatcggcagagaaagcattataggacgcaatgcgatggttgaaaacaataccagaattggaagtaaagcaacaattcaaacgggctgctatatcactgctgatatgacgattgaggatgaagtgtttatcggtccctgctgttccacgtcaaatgataaatatatgggaaagggaaactacccgtatcaaggtccaactattaaaagaggagcgaaaatcgggaataacgcaacattgctgccggcggttgtcgtcggggagggggcggtcattggagcgggtgccgtcattacaaaagatgttcccgcaggcaaaacggctgtgggcaatccaggccggttgatgaagtgacggtttttcatctcagccgtgttatataacgtgtctgcataaaaagagagatcataggatatagagcttcaatatctattaaagatcattgcagccacaaattgaagaggaattgggggtggaaaaatgtccattcgaaacgcggtgatgaacgggggttttgagacaggtaccctctcgtcctggttaggcgtaaacgcatctgttacaagccagttttcgcattcaggttttttctctgcgagatttcttggcggaacagtcacatcatatattgctcaatttgttccggccagggcgggggaaggaagcgaatttcttgtttctcttgcgagagcaagctttctcccggcaccttctgtaacgatacaggttacttattttgacagtcaatttaattttctcggatacgggctgtttgccactgtgccgtcaagcagaataccggcagccgaaaatgggacatggcttgaagtctatcaaacaacttcaccggctccctctggcaccacccaggcattcattttgatcaacaacattccgcaggcgggaactgcaagtgtgcttgtggatgatgttgctctattgagtgttgagggtggaggaggtccaacaggagcgacaggtccgacgggagcaacaggagtaacgggagccacgggagcgacaggagcaacaggagtgacaggtccgacaggagcgccgggtccaacaggagtaacaggtccgacgggagtaacaggcgcaaccggcccgaccggtccaacgggagccaccggcccgaccggagccaccggagccaccggagcgacaggtccgacaggaacgaccggtccaacgggagccaccggcccgaccggagccaccggagccaccggagcgacaggtccaacaggagtgacaggtccgacgggagcaacaggtccgacaggagcaacaggttcgacaggagcgacgggtccgaccggagtgacaggtccgacgggagcaacaggcgcaacgggagccaccggtccgacgggagcaacaggtccaacaggcgcaacgggtccgggaagtctgttgggaacaccggcgcagtcaactgaccctgtttcactcacagttggcagcgaaacaccaattctaacgacaactgttacctcttcagctggacagaatataaaactcgattctatggctgaagttgatattatcatagggccagctactacttttgaatacagtataatttttacattgtatagaaataacagcgctatcgcacaagtgtctgttgattctcaggatgaaaaatcggcaggttcggttcgtgtatatggtgatattcctaaccttacatgggttgatacaccaggggcaggaacacaaacttatgaggttagaattaatgtaacagggactaaccttttggcagccaatgttaatacaagagcgctaaatgctgtaatctttgattgattgtaaaatgaagagtcccctttaagttttcataaagcttaaagggggtttttgtttaaaagattctaatgataaattataaaatttatcatttatagcgattggcgttataaaaattcaaagaaatagagttttatccaaacggtatacatagatatttcatattttgtttgagggatattattatctcaatttttgagaaagggtggtgaaacttgattgaccattgagaatcgaataataaatggagggtttgaaaccggttctctgccgccttggacaggatttaatgccgtagttacttctaatttcagccattcagggatttatagtgttaacttggtaacttcatcgattggaatcttagctcagagctttctggttaacccgggagagaattttgaatttgttatatctatttcaaaagctagcagcgctcctaatcctgcgattgtaataacagtagattattacaactcctcttttgactttttgtcgcagggattaagcttaacaattccagtaaaccgtctatctgcagtaaatgtgtggaatgaaatatatgctacaacgaatagtgctcctcctggaaccgttataggagtggtaactattcaaaaactccctcttagtgggggggcaccgatactaattgatgatgttgcaatgataacaattgatcaaccaggagcggcttaagaagaccagcttatataagctggtcttttttgcgggtgttcgattgtatataccggaagggcaggagtgcatagacgatttcaacccttcaggccccgcgaaacggtgtgaagaataggcaagctgtcttcatcttctctggcccgtgttctgggtgttcaaatccgaattttaaagcggaaatatgaagccaataagcacattggcatgcataaaatcagtgaagccagggagtaaaacccatgcaaatagaagagtggatgctggatgttccggcaaatggatttcgagggattgaggtagctggaggattgacaaatgaatgcgtatattttgagcagtacgacgttcattttcaaaacacgccgcttgctattaagagtcgggatagagagagtcgagaagcgaaatatattgcttatcgttcgaaacgggcttaaaattgttttgaaaaatcaattcgaatacaaatttaccatggggaagagacaggaattcatggagcgtctggagaacctattataagccgtcaatagggataaatgttgctcctaagcttttgatgccatcatgcggattgagcggaacgaagtatccatattcgtctgttgtgatagaataaactgaaaataaaatttttttaatatagcctttacaaatgggtgtattcccgtatataatagtccttgtcagatcgagagttactccaacaactgacgcggaggattagctcagctgggagagcatctgccttacaagcagagggtcggcggttcgatcccgtcatcctccaccattcatattggaatgggccggtgtagctcaattggtagagcaactgaatcgtaatcagtaggttgggggttcaagtcctcttgccggcaccacgattttatgatacaatataaaagttgctgaaaaaagacagatagctttcgaaaaagtcttcagatttcattgcagtattggagccattagctcagttggtagagcatctgacttttaatcagagggtcgaaggttcgagtccttcatggctcaccatttcatgcggatgtggcggaattggcagacgcgctagaatcaggctctagtgtcttttaaagacgtgggggttcaagtcccttcatccgcattgccaatctattttgcggaagtagttcagtggtagaacaccaccttgccaaggtgggggtcgcgggttcgaatcccgtcttccgcttaatcatccagcgcccgtagctcaattggatagagcgtttgactacggatcaaaaggttaggggttcgactcctctcgggcgcgccattatataacgggaagtagctcagcttggtagagcacatggtttgggaccatggggtcgcaggttcgaatcctgtcttcccgaccactattcggggccttagctcagctgggagagcgcctgctttgcacgcaggaggtcagcggttcgatcccgctaggctccactttgttatctttaatattcaccatggcggtgtagctcagctggctagagcgtacggttcatacccgtgaggtcgggggttcgattccctccgccgctattaaaggacctttagctcagttggttagagcagacggctcataaccgtccggtcgtaggttcgagtcctacaaggtccaccattgttacggaggaatacccaagtctggctgaagggatcggtcttgaaaaccgacaggggtgtcaaagcccgcgggggttcgaatccctcttcctccgccatatattatttattattttgatcatcgcggggtggagcagttcggtagctcgtcgggctcataacccgaaggtcgcaggttcaaatcctgcccccgcaaccaaattcactcattaaatgaggattgcccgaaaggtgcagccaaaatggtccggtagttcagttggttagaatgcctgcctgtcacgcaggaggtcgcgggttcgagtcccgtccggaccgccattttaacaaaggctcggtagctcagttggtagagcaacggactgaaaatccgtgtgtcggcggttcgattccgtcccgagccaccattttacaattctatatattgcggcggttgtggcgaagtggttaacgcaccagattgtggctctggcattcgtgggttcgattcccatcaaccgccccatgcgaaatgcgggtgtagtttagtggtaaaacctcagccttccaagctgatgtcgtgggttcgattcccatcacccgctccatttgcatatcatgggcctgtagctcagctggttagagcgcacgcctgataagcgtgaggtcgatggttcgagtccattcaggcccaccatgatattccgcagtagctcagtggtagagctatcggctgttaaccgatcggtcgcaggttcgaatcctgcctgcggagccatggagaagtactcaagtggctgaagaggcgcccctgctaagggtgtaggtcgcgtaagcggcgcgagggttcaaatccctccttctccgccattttttcaataaggcccgttggtcaagtggttaagacaccgccctttcacggcggtaacacgggttcgaatcccgtacgggtcatcatgttaaactctgcatcatttcgatgcggagtttttttatattcaaatatgacatcagtcaatgtttaaaaggaaaattgttgaactttgtcaataaaaagaagcgctttcattaaagggatcaagccatattatccgaataaaagagtattctttaaatatagtggcagaaaggatgaaatcaatggctggtgtgagtgcctcggatattaaagcgcatctctttcatgaaggtcggctttatgaaagctacaggttcttcggcgctcatcagacggaacaggacggccgccaaggcttccgtttctgtgtttgggccccgcatgcgaaggaggttcgaatcgccggaacgtttaacggctggtccggtgtcctgcaccgaatggaaaagcgtcatcaggaaggcatatgggaactgtttatccccggtattggagaaggggagctgtataaatatgaaatgattacagccgcaaatgaaacgaaattgaaggctgatccttatgcttttttttctgaagtgaggccgaaaacggcatcggtcacttatcaattggccggataccaatggggcgaccggaagtggcaaaagaaaaagcagcaaaaagccgtgtatgaaaaaccgatttccatctacgagcttcatatcggttcgtggaaaaagaaagcggatggacgttttttcacataccgggaactgagcgaaacggtcattccttacgtcaaagaacacggattcacacatatcgagctgatgccgctgacagagcacccgtttgaccgttcatggggctaccagacaacagggtactacagtccgacgagcagatatggcgaaccgcatgacttgatgtatttcatcgaccagtgccatcagcatgagatcggcgtcattatggattgggtttccggccatttttgcaaagatgaccacggcttgtatttgtttgacggtatgcctctgtatgaatataaacacgagcatgacagggaaaattgggaatgggggaccgccaattttgacctcggaaaacgagaagttcacagttttttaatctcgaatgcgttgtattggatcgagatgtatcatatagatggatttcgagtcgatgcggttgcgaacctcctgtattggccaaaccgtcctcagcctgaagcgaacggctttgcgatcgaatttattcaaacgttaaatgaacaggtttttgcaaaagatccccactttttgatgattgcagaggactccacagactggccgcttgtgacgcatccgacctatgaaggcggtctcgggtttaattataagtggaatatgggttggatgaacgatgtattaacctatatggaagcttccccagaacaaagaaaacacctgcatcatcttgtttcattctccttaatgtatgcctactcagaaaattacatcctgccgttctcccacgatgaagtggtgtaccgcaaaaagtctctgcttcataagatgcccggcgattattggcagaaattcgcccagtaccgcctgctgatcagttattttatgatgcacccgggaaaaaagcttctttttatgggcggtgagtttgctcaatttgatgaatggaaagacgaagaagagctcgattggtttttggacgattttgacatgcaccgcaaagcccgaatgtttacaaaggaggctctacacctctacaaaaaaagccgtatcctgtatgaaaatgatcatcggcagcaaggattcgagtggattgacgttaacaatgcggaacagtcgattgtatcgtttatccgctatggaaaacagcccggtgaagcgctgattatcgtctgcaatttcacgccttccgtctatcacgaatatcgggtcggcgtcccttttcaaaccgaatatatcgaagtgcttaacagcgatgatgcaaaatacggaggttcacaccaaatcaacccaaaacgccttcaggcaaaaaaaggcgttctgcacggcaaaccatacagcatcagcatgacagtccctccgctgggagctgcggttttcagagcagtcaaaaagagaggagcgaaaaagggatgaaagaacaatgtgtggctatgcttttggcaggcggcaagggaagcaggctgaatgccttaaccaaaaacctcgcaaaacccgccgttccatttggcggcaagtacagaatcatcgattttgccctcagcaactgcgccaactcgggaattcatcatgtcggtgtgctgactcaataccagcctcttttattaaactcatatatcggaatcggcgagccatgggatcttgaccgcaatgacggaggggtctccattttatccccttatgctgaagcgtcggaagtgaagtggtacaaagggacggctagcgcgatttatgaaaaccgccattttttaaaggagcttcagcctgaacatgtactcatcctatcaggagatcatatctacaaaatggactacggaaaaatgctcgaataccacgcggagaaacaagctgacgccaccatcgcagtcattgaagtcagctgggcagaagccggccgtttcggcatccttcatacgaatgacaagatggagattacaagcttcgaggaaaagccgaaatatccaaagagcaatttggcatcaatgggtgtctacgtttttaaatggagcgtgcttgaagatgcgttggaacgcgatgaaaaaaattccgcgtcaagccacgatttcggaaaagatgtcattccggctcttctcgaagaaaataagaggctgaacgcttatccgtttaaaggatactggaaggatgtcggtacggtcagaagtttatgggaagccaatatggatctgcttggagatcatcctccgcttgacctgttcgaacggaactggcggatttattcagtctccccgaatctcccgccgcagtttgttgccgatctggcggaaatcaaagaatcgctcgtcagcgaaggatgcaccgtgtatgggtcggtcacccgctcggttatatttcagcgcgttgccatcggcagacattccgccatcaaacgttcagtcgtgatgcatgacgtttcaattggagagtatgttgagatcgaaaatgccattgtatcggcaggaattcgaattccggacggtttttgcgcgaagccggaagatggcgaagtcctgctgatcacagaggagtatgtcaaaaaacataaggttgtttaaacaacgcggagaggcggatggtgtcaatgaataatcaaatgttgggaattattgatgcagctgtaaaccagcactctcttcaggacttaacggccggccgctcgaccggagccgttccgtttgcaggaaggtaccggctgatcgattttgcgttgtcaggcatggttcatgcaggcattcggagtgtcgctgtattctccaagtccccgtaccgctccttgatggaccatttaggatcgggaaaagagtgggatttaaacaggaaaagggagggccttttctttcttccatcttcacttccccatgatgagcatgttgggcttggatcgtttcggcaatttgcggagcatctcgattattttcaaagaagcactcaacaatatgctgttgtggcaaatagctatacggtctgtcacataccttttcaagaagtgctcaaacaacaccttgaatccgggtgtgatctgactgaaatttgtcacgaaggaaagcctttaggaatgtatgtcactaagaagagtctgttgtgggagatggttgaagggcattgccctgaaggagcccaatcttttgaagaagtctgccggaaagagcgcggctctctatccgtcaacagctatgagcactcgggatatacagccgtgatcgattcccccgaaagctacctttttcatagtttgaaccttattcagcctgtgttttgggagcaagtctttcatatgggccagcctgtctacacaaaaataaaaaacgatcctcctgtaaaatacgctaaaaacagcagggtaaagcaatcgattatcgctaatgggtgcgtaatcgaaggtgaggttgagaattcggtcttgttcagaggggttcacgtaggaaaaggaacaaccatcaaaaacagcgttgtcatgcaaaaaacaaggatcggagaaaactgccggcttgagcacgtcatctgcgacaaagacgtcaaaatcggccatcatatcgaaatgtccggcaccatgagcctccctttcatattaaaaaaaggagccatacaaggagcgctgatgaactcttgaaagtcttatttgctgtttctgaatgtgtgccgtttgttaaatcaggcgggctcgccgatgtcgccggggcgctcccgaaagagctcgcccttttaggcatagaaacggtcgtcatgatgccgaaatacagtttgattgcggaagacgtcagaagacggatggttaaaacggctgaatgcgaggttcgcgtcgggtggcgcaggcagttttgcggcattgaacaccttgaacatgacggagtttcctattattttcttgatcatgggtattattttaatcgggattccctttacggccattatgatgatggagagcggtttgcttttttctcgcgggctgttttggaagcactatacgcgctgaattttgaagctgatgtcatccatacccacgattggcacacagggatggtcaattatttattaaaagaagaatatcgaaaaaagccgttctatcagcacatgaaaagcgtatttacaattcataaccttcaatttcagggcattttcccgaaggaagcggttcatgacctgctcggacttgatatttcccatttcacgaccgaaaagctcgagttttatgggaacattaattatatgaaaggcggcattatcgccgctgatcaggtgacaacggtcagtccgacgtaccgcgatgaaatcttgactccatactacggcgagcggcttgaaggggtgctgtcagacaagaaggatgcactgacaggcattttaaacgggattgacgatgtgctgtacgaccctttaaacgatccgcacatcgattatcattacgatgccgtcaaccgggacggaaaacggaaaaataaagccgtgatccagaagacattcggtctgccggtgaatgaagacattccgctcatcagcatggtggcaaggctgacgaagcaaaaaggcttcgatttgatcaagcgggtattgcatgaactgtttgaagaggaagacatgcagctgatcgttttaggaaccggagaagcggaatttgaaaattacttccgctatatggagcatgcttttccggacaggtgcaaggcgtatatcggttttaatgaaccgctcagccgcaagatttatgccgcgagcgatcttttcctgatgccttcaaaattcgagccgtgcggtcttggacagctgattgccctcaggtacggcgcggtgccggttgtcagggaaacaggcgggcttcatgatacggtgaccgcttaccgggaaacaaccggtgaaggcaacggttttacgttcgcccattttaacgcccatgatatgaagcatacgatcaaaagagcactgtcattttatcacaggaaagaagagtggggcaggatcgttcaaaaagcgatgacacatgatgtcagctgggctttgtcagcccgtcagtatcagcggttatacagccgggagataaagggggaagcgcatgttctcaagtaaagaaagctttaaacaatgctttttgaaacgtgttgaacggttgtgcggaaaaagctttcgggactcttcaacgcttgaccagtatcagacgctcggcatcatggtcagggaacatatcagcgcaaactggatcgagaccaatgaaaggagccgctccaaccaaaataaacagacctattacttatcgattgagtttctcctgggcagactgctcggccaaaacctcctcaatctcggggttcgtgagattgtcaaagaaggtcttaccgagcttggcatttgtcttgaagacatcgaagaggccgaaatggatgcaggccttggcaacgggggattgggcaggctcgcggcgtgctttttggattcactggcttcgctcgaccttcccgggcatggaatggggattcgctacaagcatgggtttttcgaacaaaaaatcgtcgacggtcatcaagtcgaattgcctgaacaatggctcaaacatggttacgtatgggagatccgcaacgccgatcaggctgtttgtgttcgtttcggcgggcgggtcaagatggcgcaggaaggagggcgcctccgcttttggcaggaagatgcggaagtgatgacagccgtgcctcacgacatcccaatcatcggctatgagaccaagacggtcaacacccttcggctgtggaatgcggagccttgctcgctccatcatgaaccgaatattttgaagtataagcgcgagacagaagctgtatctgaatgcctgtatccggatgacacgcatgacgaaggcaagattctccgtttgaagcagcagtattttttagtatcggcaagcctgcaaagcattgtgaaacgctataagaacactcacccgtcactgcatgattttcaccaaaaagtcgcgatccatatcaatgacacccatcccgctttggcggtgccggaattgatgagaattttgcttgacgaagaaaaaatgacgtgggatgaagcgtggcatgttaccgtacatacgatctcatatacgaatcatacgacgcttgccgaagcgctggaaaaatggaggatcgatttaattaaaccgcttctgccgagaatttatatgatcattgaggagatcaatgagcggttttgcggctggctgtgggaaaaatacccgggtgaatgggaaaggatcgaaaagcttgccgtcatcgcccacggcgaagtgaaaatggcccacttggcgattgtcggcagctacagtgttaacggtgtcgccaacattcattcgaccatattaaaagagagggaaatgaacgacttttattccgttttcccttttaaattcaataataaaacgaacggcatctcacatagaaggtggctgttaaaggcaaatccgccgcttgcgaacttgattactgaagcgataggagacaggtggctgaaagatccggaaagccttctggatcttcgtccatttgcgaacgattccgtgtttctcgagtcgtttcagcgcattaaaagggaacgaaagcagcttttggcagacatgatgaaaggcagcgtcggcttcgccgtcaaccctgacagcatcttcgatgttcaagtcaagcgtctccacgcttataagcgccagcttttaaatgtgctccatatcatgtatttgtacaacaggctgaaggaagacaaaggctttgccatttatccgcaaacctttattttcggagcgaaggcatcgccgacttatcattatgccaaaaaggtcatcaagctgatccattcagtcgcagataaaatcaatcatgatccggatgtcagacattcgatcaatgtgatctttctggaaaattaccgggtatcaaccgccgagcgtatttttccggcgtcagatgtcagcgagcaaatatctgcggccagcaaagaagcctccggaacagggaacatgaagttcatgattaatggggctttgacgatcggcacgcatgacggcgccaatattgaaatgcttgagagggtggggacagagtgtatctacacgttcggtttaaaggcggatgaagtgctggactacgcggaaaaaggcggctatctgtcaagggaatactatcagcatgatgcaaggatcagacaaacggccgatcagctgatcaatggttttttcgaaggagaagccggcgaatttgagccgatttatgactcgctgatcgcttataatgatgaatactttgttttaaaagattttgcttcttatattgtagcgcaggagcggattcaaaaagactacttgaataagcgtctttgggctgaaaaagccgtcacaaacatcgcgcatgccggatatttttcaagcgaccgcaccatccgggagtatgcggacgacatttgggaaattaagccgtaccagcattgaatttaaaaacactaagccccgctggtcaggggcttagtcgtcgtcttcagtataaggatccttttcataagccgggagatcgccgaaagaggtcatgatgccttcttcatcaagcaggtcttcatatttttcgtgttctttcgtcggatagacggtaacatcttttccggtaatgtctgttgcggcatagttttcgtaatcttccacatatccgagcggctcttcatactccatgtacatctggctgtatgacagaggcggaacggccagatcttgaggcgtttccgaattgccgtagcgttcgacatcctggtaagcgtcctctgaatcgtatgcgacattttcatcgtcctcgtcttgttcaaaatgtccaaacggcgggttcagcacttcttcctcaatcggccgatcttttgaaacggagacggttgacgaatgttcactgcacgtcgttgcggttggaagtacggacagcctttcatacgggatgtcctttccgcatacttcacagcggccgtatgttcctttttcgatcatggctaaagcatgttcgatatcgtgtaaatgctctctttcatgttcaaaaagggcaaggtctttttcgcgttcgtacagttctgtaccttcatctcctggatgattgtcataagccgaaagatcgcccgtcgagttgaacgggtgcgtcgcatcgatgccaaaatgtccgttttctttaaagcggctgatgatctgttcttttccggctttcagttcattttcgagttttgtcaactgttcttttgttagcacatgcatcgcctcgtttctttaaagtgctcgcgtttttagtatgaacgaattcaaacagaactttcattgtaaataaaagcaaaaaaaagagccgtataggctctttttttaaaaaacgtactgaataagcagggcgatggcgagcagaaggccgaaaaaggtgttcgtctgcgcagtcgatttcatggcgaccatcagttctgccggcttttcttttgccttgaactcctggatggctttaatcggtttaggcaggcttaaaagaacgaggcagctccacagagaaacgatctcaaagccgatgtatataccgatcaatatataggaaacagcaaaaacccagcttaaaatctgcacggcgttttttcttccggccaaaatcggaagcgtcttccttccgttttctttatctccgaccaaatcgcggatattgttggaaagattgatgcctccgactaaaatcgtaatcggaagggagatcagaaagacgttccaagtcagcccgccggtttgaatatagtatgaaatcaggatgatgaccattcccataaaaacgcctgacataatttcaccaaacggcgtataggagatcggaaacggcccgcccgtataaagatagccgacggccatgcaaaccaatccgatcagcgcaagccaccagcttgaagaagcgcagatgtacacgccgagtaaaacggctgctccaaacagtccgtatgccaggtataaaaccgtcttcggtttcattccatagcggacgatagcgcctccgatgccgaccgagttttcattatcaagtcctcttacaaaatcaaaatactcattgaataagttcgttccgatttgaatcaatattgatgcggccagcatagctaaaaacagccagatgtcaattttccccgattcaagggacatcacggtcccgagcgttacagggacaaaggcggctgtcagtgtatggggtcttgttaacatccaccatacgcgccatttttccggctttatttcagaaacactccctgaaagtgattgatgctgcataaagtatgactcctttagttttaatacgtacacgtccatactaagtttagaaaaagttaaaaaaggtgtcaatataatgggtgatattgttagaaaaaaagcggccgtcctgcaattcgaaaataataaatgaccttgtctttttcaatcggccgattacgtttataataggtggtggcagttgttaataaagtgtcgttttgttgacacataccgttcacaggtgtatggttataaaagcattttacggattttggaggaatgtatcatggtgacaacagtgcagcgcactttcctcaaggaagcgcctgaagcattaaacatcgtcaaaaaagtcaaccatgctgttttaataagctattccagaaaaattgagagcatagatgctctttcctttttcataaacgggaaagaacaatttgccggggaacggttcttctggtctgatccggacggcgggctgacgcttgtcgggctgggaaaggaaatatcggtttccacagatctgaaggatgccggacgttatcaggctgtacatgaaaaatgggagcgcttaaaagagaaaacctatcactttcatgaagatcaaagcagaggtcaggcagcggtggggccattgctgtttggcggtttttcatttgatccgctggaagatcgcaagcagcattggaacggctaccaggaaggcgctttttttattcccgccgctatgctgacacaggacggagaggaaacattcataacggtcaatagatggaagactcctgaagaagacgtgcgcaaagtacttgaagaaataaagggcgctgcttcacagctgaccaaggcggacgattcccgttatccggaaaaaggtcatacgcaatataccgccaaggaagagcttgatgttcctgaatggcttgaagcggtccggcgggcgacagacgacattaaaaacgggaagtacgataaagtcgtgctcgccagagagatccttttaacgttcgatcagcctgtcgaacttcacagagtattattcaatctgatgtctgaacaaaaaacgagctatatattcgccattgaagaaaacggcaaaagttttgtgggcgcgtctccggaacgtcttgtcaaaaaagacggagagaacgttctgtcgacctgcctcgccggttcaatcaagagaggcgaaagtgagcaggaagaccggatgctcggtcttgagctgttaaacgatgaaaaaaatctaatcgaacatgacattgtcgtcaatatgattcatcaggcgcttttgtcaaattgcagcaatatcaaaaagccggccaagccgggactttacaaaacaaaaaatgtgcagcatttgtatacgccgattgtcggcaaaatgaatgcggagtcctcgatttttgatttaatcgagaagcttcacccaactcctgcgctcggaggagcaccacagcaaaaagcgattgaggttatcagggagttggaaccgatgtcaaggggctggtatgcggcaccggcgggctggatcgacatgtccggcaatggggaattcgcggtggcgatcaggtcgggacttatcgattcaaatgcggccagaattttcgccggctgcggggttgtggctgattccgatcctcttatggaatacgaagaaacacaaattaagatgaagccgatgctgtctgctcttggaggcgatatccgttgactgaaaatccgattacaaaatatatagggaattttattgatgagctttcccttgcaggcgtgacagaagcggtcatctgcccgggatcaagatcgacgccccttgcgattttggccgcgagtcatccggacatcaatgttcatatccatgtggatgaaagatccgctgctttttttgcaatgggcatggcaaaggcaatgcggaagccagtcgcattgatctgtacatccgggacggctgcagcgaatttctacccggctgtgatcgaggctcattattctagaataccgcttatgatcttaacggctgatcggccgcatgaactgagagaagtaggagcacctcaggcgattgatcagcaattcttattcggaaactttgttaagtttttcacagactcggctttgcctgacagtcatcctgacatgctggcgtacatccggtctttggcagcacgtgcagccggagaagccaaaaaagcgccgcgcgggcccgtgcatatcaactttccgctgagagagccgctcatgccgaaccttgaggatgaaccttttcaaaggctgagaagcggcagtcatgtgacggttgaaagcggccgcttccgtgctgatcggcatgagcttgtagcgctgagtgctctgattaaagagaccgaaaaaggcgtaatcgtctgcggagagctgcaagatgatgatgcaaaagaacatattgtagctctttcacaggcagcagaatacccaattttggctgacccgctctcaaacttgagaaacggcacccattcaaaagaaaccattatcgatgcatacgactcattattgaaagaagaacagctgaaacgcgagctcatgcctgagcttgtcatccgcttcggtgcgatgccggtttccaagccgctttttcagctgctgaagcaaaatccgagcattaggcaaatcgtcgttgatccagatggaggatggcgcgatccgactcagctcagcgcacatatgctgcattgcacggaagaggagattgctgttcttgcggattccgctgtcaattcagaaaataggacaggcaactggcttgagaagtggcggtttgccaacagccgcttccgcgctcttttaagaaatcttgaagctgaggatcttacctttgaaggaaatatctaccggaaccttcagcatttgattccggacaacagctccgtgtttgtcggaaacagcatgccgatccgcgatgcggacacattttttgaaaatcaggaacggaccttccggatttttgccaatagaggggcgaacgggatagacggtgttgtctcaacggcgctgggcatatatgccgcaacgaaagaaccggtaacccttgtcatcggcgatctgtcattttatcacgacttaaacggcctcctcgtcagcaaaacgctcgatattccgctgactgtcgttctcgtcaacaatgatggcggcggcattttctcatttcttccccaatctgctgaagaaaggtacttcgagctcttgttcggaacgccgacgggtctcgaattcgagcatgctgccaagctgtatgggggacgctatatatgccctgaatcatccgcacattttgccgatgcgtatttatcctccgtcaaccgccgcggcttggatatcattgaggtgaaaacgaagcgcgatgatcgtgtggagcagcatcgccggatgcttgattccgcgctgcatgaaataagaaaagagtggccgttttgaaattgacactgaaagacggcgtttcctataaaattgaagacaatggcctgtctgcagaaaaaacggcggtgtttttgcatggctttacaggaagcgcggccacatgggacgggatagacggctattttcaggggatgcgtctgatcaagctgaatctgctcggacacggcggaaccgactcgccatcggacagccggcgctacacaacagagaagcaggcagcggatctcatcgaaatttttgatcgtttaaatgtaaaacaggcttacctcatcggttattcaatgggcggccggcttgccttatccttggcgatgattcaccccgagcgtgtgtccggtcttgtgctggagagcagttctccggggcttgattcgcctgaagaaagaaaagcgcgcagggagcaggacagccggctcagcaggcggatacttgaagaaggaatcaagtctttcgtagattattgggaaggcattccgctgtttgcatcccagctttcaatggacccttcaaaaagaaaaaaagtgcgcgaagaacgtctgaacaacaatccgatcggccttcgaggcagcttaatcggaatggggaccggatcacagccgtcttggtggaacaaactgagcgggatcaattatccggtgcttctcatcgcgggaagcctggatcagaaatttgtcgccatcaatgaaagcatggcaaagcggattccagccgcccgcctcgagattgttgaacataccggtcatgcggttcatgtggaagagcccgatttttttggtagaatagtaagtgagtttattttaaagtaggaggtacacatcaatgactgtagaatggaaaagcgaacgtcaatacgaagatgtattatatgaaacatataacggcatcgccaaaatcacgatcaatcgccctgaggtacataacgcatttcgtccaaaaacggtttcagaactgatcgatgcgtttgcatatgcgcgggatgatgccaatatcggtgtcattatccttgcaggtgccggggataaagcgttctgttcaggaggagaccagaaagtaaggggacacggaggctatgtcggtgaagacgagattccgcgtttgaatgtgcttgatcttcagcggctgatccgcgtcattccgaagcctgttgtagcgatggtgtcaggctatgcgatcggcggcggccatgtgctccacgtcgtatgcgatttgacgattgctgcggacaacgcgattttcggacaaacagggccgaaagtcggcagctttgatgcgggctacggatcaggctatctggcgcgtatcgtcggacataaaaaagcgcgcgaaatctggtatctgtgccgtcagtacaacgctcaggaagcaaaagaaatgggccttgtcaatacggttgtaccgcttgaaaagcttgaagaagaaacgattaaatggtgtgaagaaatgcttgagaaaagcccgacagcactcagattccttaaagcggcctttaacgccgatacggacgggcttgccggcatccagcagtttgccggagatgcgacactgctttattacacaacagatgaagcgaaagaaggccgcgatgcgtttaaagaaaaacgccgtccagacttcggacagttcccgcgttttccttaaaaatcggaagagagaaacagcttggtgcgactgagctgtttcttttatcattcaagacattttttggagatgatgatatgctgatggaccatccgaattggcttaaacagcgagcagaactgacacctgacaggatggctgtgattcagggagatcacaagctgacttttattcaattatttcatgaagcaaaaaaaacggccggccggctgaagagctttggtctgaagaatggggatacagcggctttacttctcacaaaccggatggagatggtcatcgccgtccatgcctgctttcttctcggcgttcgcatcgttttgctgaatacgaagctgtcaatggccgaacgatcatatcaaattgaacattctgaagcaaagctattgcttacagagaagcctttcatagaagagcatagagggggacagccggctcgcgctgttgacattgaagacgttcaaaacgccgcttgcccgccggttacagaaatcgaaagcattcatttggacgatgcggcaacaatcatgtatacgtctggaacgaccggacggccgaaaggggttatgcagacatttgcaaaccattatttcagcgcggtttcatccgccttgaatttggggctccaagaacacgaccgctggctgatcgccttgccgcttttccatatcagcggcttatcggcgctttttaaatcggtcatttacggaatgactgtcgttttgcatcaaaggtttgacgcggaagaagttcttcgttcgatcaaagaccagcaagtaacgattgcatcggtcgttcagacgatgctgtcgaggcttgcggcaaaagtcgacagatgccccggatcattaaggtgcctgttattgggcggagggccagcaccgctttctctccttgaggaatgcaaaagaaagcggctgcccgtcgtacagtcgtacggaatgactgaaacgtgctcacagattgcgaccctcgccccggaatactcgattgaaaagctcggttcagccggcaagccgctgtttgcatcaagcatcaaaatcgaaaagaacggaacggaatgccaacccggagaacatggtgaaataaccgtaaaagggccgaccgttatgaagggctacttgaaaaatgaggcggcaaataaagactcattcaatgacggctggtttaaaaccggtgatatcgggtattttgacgatgacggatttttatatgtgctggacaggcgttcagacttaatcatatcaggaggagaaaacatctatccggctgaagtcgaggccgttcttctgtcacaccccaatgtcgcggaagcgggggtgaaaggagtcgatgacaaaacttggggaaaggttccccacgcctatctcgtcgccgacagccccgttgatgaagaggagctgagcgaattttgcaaagaacggcttgcttcatataaagtgcctaaagcatttcattttgtcgataggctgccgagaaatgcttcaaataaactgatgagacataaattgtagagggagagcgccatgattcaaatcaaacagctgacattgtaccatctcagcatgcggctgaaaaagccttttaaatcaagcttggaaacctttcaggatcgcaagtttatcatcgttgaagctgctgatcaagaaggtgtgacaggctggggggaagtatccgctttttcatctccgtggtacaccgaagaaacaacggagacatgctaccacatgctcaaagattttttgattccggctgtgctgcgcgaatcattcacacacccttccgaagtgcccgaggcgcttcgcggattcaaaggcaaccgaatggcaaaggccggccttgaagccgccttttgggacatttacgccaggaaaaaagggatctctttaagagaggcgctgggcggagtaaaaacagaagttcctgccggagtcgtcgtcggtcttgccccattggatgatatgcttcaggaaattgaacaatatgtaaaagaaggatttcaaagaataaaaatcaaaattcagcccgggcaggatatagagcttttaaaagaaatacgccggcattttccgaaggtgccgctgatggcagatgccaactcttcttatgaattaaaagacatcagccggattaaagagcttgacgcatttaaattaatgatgatcgaacagcctctggctgatgatgatatcgttgaccaccgccatctgcaaaaacatatcaaaacatcaatttgtcttgacgaaagcatccgttcggctgctgatgcgcgaaaggcaattgagctcggcagctgcaaaattatcaatataaagccgtcccgagtcggcggtttgacagaagctctgaaaatccacgacatctgcaaagaacatcaaatgcctgtctggtgcggcggcatgtttgaaaccggcatttcaagagcccataatcttgcactgagttctcttccgcagtttttgattcccggggatctttcttcatcctcaaggtattgggaagaggatatcgtaaaaccggaaatccggatcgagggcggctatattcaggttccaaccttaccgggaatgggatttgaagtcgatactcatattttaagaaagaattcatctaaaatagacgtttttaagcagtaaaggctgttttaaacgccgatttccagattttcaagctttgttaaataggcggcctctcatgtatattaaagctgtacattattcccttctcgtttggaccggctttctagccggtttttttaacataaaaagagctgcctttatgacagccctttcctttaatcgcccaaaagcaaatcttcgtgcacgatctgtccgatcacccggtccgcttgatccggcagcccgtcgagacagccgtattcataatcccataagttcatgaaggagcgggcggctttttgaaatgcggtttcatccgccccgtggatttcctgataaaaagcctgtaacagcgactctttattcacgactgtccctccttcattcatccgttttaatgatgttcaggtttaaaggttttgcaatccgtttcttcactattagaagctttttcaccttcagcatggctgacgacatagatggcgtcggctgtgcatttgttaccctcttcccaataggtgcagttgctgacttcacacagtattttttgctccatttagtttgggccccctttaaaagttgtacacatttagcttaaccttattcatgctgtttgatgtaccgcttgtccttcatgaacaatttccagaaataataaaagccggggaataaaataataaaaccgacgatgtaggagatgaacagcgccctgaatgtctccggtgcggtgaagcccgattgaatcgtgacatcaggatagaccatgtaaggaaggtgcgccctcccgtacacatagctcgccgtaaaatactgcagcgtaatggcgatgacagccaggcgcggctttcccagccggtcgctgttatgtctgtttggcagaaacagagccgcaaatgcgacgagaaacagcaaaaacgataaaatcagccatggaagcccgtccatcatttttgtataaagccagctggcttccgtcctcatggtcatcatgatgctgaacgacatgagcagtgcgagcggcccggtaattaaagcgtttcggcggtagacctgatacgcgtctttttctccggctacatttgaaaaatcagccagcagcagtgaagacagaaacagcgtactgaaaatggcgaagcccataaaagaataggcatgagggcttaaaaacaaattgacaaagtccaattggtggcttccgtctacctggtatacgaaattgccgtgtgtcacaggcaagacaaggattaaaacagccggaatgataaagccgctgatccctgaaacgtaagtcagcgccctttcataatcttttgcagcgtgggagaagaccaaaaatccgcttcgaatcgccaaaagcaataaaatgatgctgccgggaatcaaaagcacagtccccagcacaaaagtgccgcccgggaaaaagctgaaaagggctacgacgattccgacgatgaaaacattggttacttcccaggtcggagaaagatagcggtttgcaatattggttgctttcagctgttttttgttcatataaatcatcgaccaaaatcccgctccaaaatccatcgacgccataacggcgtatataaatataaatccccagacgatcgaaatagccagcagggcatctgttgttccatccagttgcatcatatgacttcccttctgttttttttgtgcattcagctgctttttaagtcctcttcgacaggatggcgtttaaagtaatattgcaatacgaacaccaccgctcctcctaaaatgatatagacgataaagaacaaaagaaacaatatgccgatcgagccggaggtggtcactacttccgacgttttctgcatatggtaaatgacccaaggctgccttccggtgcaagcgaatacccagccaagttcgattgcgagcaatgcgagcgggccgccggttatgaacacggccagcatccagcggggaaagcggtcttttttcatgacttttctccaaataaaacccacagcggcataaacaatcaaaaggctgccgataaaaaccatgccgttaaataaggtatgaatgaacaggggaggccactcatcccttggaaagtcattcagcccttttacgacggtgtcaaagcggttgtcggccaaaaagcttaaagcccacggaatctcaatcgcccatttcaccgattgcgtcttttcatcagtaaatccgccgatcgcaagaggagcatgggactgggtttcaaacagcccttctgcgcccgccagtttttcaggctggtagcggtgaagtagctgtgcggattcgtgcccgctcagagccgtgaccagagaaaacgctcctccgacaatcagcccgagcagcagcgctttcctatgaagggcgtagactctatcatcgccgcggtttcggagcattttgtaggcggctatcgtcgcaataataaacgcacctgtcataaaagcggagacgacaacatgtcctgctgtggccacaaagcttttgttgaagaacgccgtccacggctgaacatccgtaatttcaccgtttacaattttgaagccttctggcgttccctgaaaagcgtgcacatttgtaatcaagatggccgatgcggctgctccgataacgataaaaatgacggctgtaattctcataagtggagtcagccgatcggctgcgtaaacataaatggacataaataaagcctcaataaaaaaggcgtagatttcaatttgaaatggaagggacatgacttttccgatcacttccatgaatcccggccagagcagggctagctgcgtgccggcaatggttccggtcggtatggcgaccccgagcaacacggcctgcgccttcgtccatcttttggccataatggcgtagtggggatctttcgttctttgatagatcagctcggccagcaaaatcatcaaaggaattccgacaccgagcgaggcaaaaataatatggaatcccatcgttgttccgaaaaggcttcttgcaaaaatcaagtcattcatccggaaaaccacctttcatttacaccattttgctttttattgtttaccgccttttttagattattcttcctgtaggaggttaaaatggataaagggattaagtatggcaaatgaacattcatttttgacacagggatttgaaaggtatataataaaacgtaattattacgttttgataggaggaatggcatatgaaaccaaatattcatccgaaaacttatcaagtgatctttcaggatgtaaacagcgggtaccgttttttaagccgctcaactaaaacttccgatgagacggccgagtgggaagacggcaagacgtatcccgttataaaagttgaggtgagctctgatacccatccgttttataccggaagacagaaattcaatgaaagaggcggaagggtcgaacagttcaagaaaagatttaatatggattaataaattaaaaagaccggatgtttccggccttttttttcgtccatttaaaaaacaagcgcatgacatctcatgcgcttgttctctgttatttgcttgataaagcttttttcaagacgtccaggttttctttcatgatggcggtataatctttgccgctttcaatgtcttcttttgttacagattcaaggtttttcatcgtcagactttccgctccgatttcttttttgatgatctcggagattttgctgctgacattgctttcaaaaatgatatatttaatattatgttctttcgctgttttaacaatgttttcaagctgcttttgtgaaggttcctcagtaggcgaaaggccgagaacgcttatctgcttaatgccgtagcgtttttcccagtagccgtaggcggcatgtgagacgagaatttcttttttatcagctttgtcgactgtttgtttgaagtctttgtcaagctgctccaagtctttttttaatgactcatagtttttcgtaaacgttttttcgtgttcaggttctaattttacgagttggtctttaatgttttcggccattttttcagcaaggacaggatcaagccatgcgtgcgggtcatgatctccatggtcgtgatgatgatcgtggccttcggcttctccgtgttcatgttcttcttcatgtgcatgctcatcgtgctcaccgtgttcttctccatgtgcatgctcatcatgttcgccttcttcttcacgtgacagaaggtcaatgccctccccggctttgacgattttgacgtcgctgtttttaagtgtgcttacagctttgtctgcgaatccttcaacaccgactccagagtatataaaggcatccgagtcggaaatttccgccatcgtttttgagcttggctcgtaagtgtgcgcttcaacgtttggcgggtaaacacttttaacgttcacatattctccgccgatctttttggtgaagtcttcaagcggataaatggttgtatagatgtccagcgtgtctttattttctttttgttcactggaagctccattgcttgagcaacccgctgttaatccggcagcaagaatgaatgcagatgctattccgaatgtttttttcatggtatttctcctctcaatgtaaaactgaaatggttccgatttaatggtcctgtatcattgtatcgtaataattacgatttgaaaagaggaaatgatagttaaatatactcaggcagtgaatcaagtaaggccgaccagtctgaattcatttctttatctgtaagaagggtctgatccagggagcggataatgtcttcctgattcatgtcaatgccgataaaaacgatttccgttttccggtctccgtatgtttcatcccagtccgctttcaaattagggtcctcttcaaacgcgagcttttgttcttcctcggtagacgctgcaatccaggggcccgcgctttggatcatcagggaagagcctgcctgggacagaaggcctgctgtgtcatttcgagaagcaagccagaagaagccttttgctctgataatttgcggcggccagttttcaagccagcgcttcagtctttcaggatggaaaggcctttgcttttgatagacgaaagaagagattccgaattcctctgtttcaggtgtgtgctcttcattcagctctttgatccatcccgctgattgacttgctttttcaaaatcgaacgatttcgtattcatgatggccgaaagcggcacttttgcgaatgccgcagaaatgattctgcagtccggattcagttttctcagggaccagaacagcttttcctgctcttcttcattgagtaaatcagttttattcaaaatgaggacatcggcaaattcaatttgctcaattaaaaggtcggccacttcccggctgtccgtttcatctgccgcctgcttccgttccaataggctctcgcccgaagcgaagtcctcaaaaaaacggctgccgtcgacgacggtgaccattgtatcaagcctgcaatatttgcctaaatcaatattcagctcctcatctttgtacgtaaaggtttgggcgacgggaatcggctcgctgataccggaagattcaatgagaatataatcgattccgccgttctccgccagctttttgacttcgatgagcagatcgtctctcagcgtacagcaaatgcagccgttctgcatttcgacaagcttttcatccgtgcggatgaggtcaccttttttcacgagggagccgtcgatattaatctcgctcatatcattgacgatcacggcgattttcaagccgtgcgcttcatgcaggacatgctgcagcagcgtcgttttcccggaccctagataaccgcttaaaacagtgaccggaatcaggttttccttcatgtttttcaccttccttaaaacgtaattgtttcgatttgcacaaaggaaatcttactggacttgtgaaaaaaatacaagaaatatgttatatttagatataaaaagcgtttagaaaggaaatgagccatgaaacttttggataatattctacagttcaatcaacagtttgttgaacggcaggactatcaaaaatatcaaacaagcaagtttcccgataaaagaatggtgattctgtcttgcatggacacaaggcttgtcgagctgcttcctcatgccatgaatatgcggaacggagacgtgaagatcgttaagagcgcgggcgcactcgtggctcatcctttcggaagtattatgcggagcattctcgttgcggtatacgaactgaacgctgatgaagtatgcgtgatcggccattatgactgcggcatgagcaagctgagctgcgacagctttttggacaaagtcgtcaagcgcggcattccaaaagaacggattgaaacgcttgagtactccggcgtcgattttgaacaatggctgaaaagctttgattctgtagaggacagcgtcagggacagtgtaagcgttattcggaaccatccgctgatgccggaggaagtacctgttcacggacttgtcattgatccggaaacaggcagactggatctcattgtcaacggatatccggaagagcgctaatccttttgctttttttccggaacgggatctattccgccgggatgaaacggatggcattttagaatccgcttgatggtgagccatccgcctttaaatgcgccgtgcttttcgatcgcttcaagaccgtaattggagcatgtcggataaaaacggcaggtcggcggaagagccggtgatatccatttttgataaaagcggatgagcagcaggaatacggttttcatgtttttcgcaccttttttgttttgatcttattataatataagcaaaaaacgcataaaaaggaaaagcattcacctgaaaacttatcggtaaagtatgatataatacaaaaagaccgattagaggggagagaggaaccatgccttcagttgaaagttttgagcttgaccataatgcggtaaaagcgccttatgtcagacactgcggcgtccacaaagtgggaacggacggcgtcgtcaacaagtttgacatccgtttttgccagccgaataaacaggcaatgaaacctgatacgattcatactttggagcaccttcttgcatttacaatccgcacatatgcggaaaaatatgaccactttgatattatcgacatttcgccgatgggctgccaaacgggctattacctggtggtaagcggtgagccgaaagtggaagaaatcgttgatttgcttgaggatacgttcaaagaagccgttgaagtgactgaaattcctgcggctaacgaaaaacagtgcggccaggcaaagcttcacgatcttgaaggcgcaaagcgcatgatgcgtttttggctttcgcaaaataaagaagacctgctcaaggtgtttgggtaaaatgattgaaaaaaaccggctcataagagagccggttttcattttttgttcacaaagaaaataatgccatttatccctgaactttgctacactttatattgtaatacatatcatagaagaagggtgataggatgcgttttggaaaatggttcattctcttatgtttagcggtcggtctttccgcctgcagccagggggacaagcaggcggcatcggatgaggagcccaaagtgctgacggcaaaactggcggcgcctgaatcggcggccaaaaatgaaaaggctgtcataaaagcgaccgtcctctacggggaagagccggttgcagatgccgatgaggtggagtttgaatgctggaaggccgggagcaaggaagatagcgagctaatcaaagcgaagaatgagggaaaaggcgtatacagcatggaaaaagcgtttcctgaagacggccattacaaagtccaagtccatgtcacggcgaaaaaacagcatacaatgcctgttgcagacattaaagtagggaaagcgacggatgagaccgatgaagatgaaaaagaagaagcccaccatcattgatggggctgttcttcttcccgcgacgggaggggatcgacttcatgcttgaagtcataagcttttgatgttgtgacaagcgatatggacagaacggcgccggtgatcagaattcctacaataatccaaaagaggatcatcacttacctccgaatagctttttccaacagtttaccatatcaggcaaagaaaatcatgataaagagtaaaagaaatgtttcctgcacaagctaaacgggtaaatcaaaagtaaacgaaaaggaggacgatctaatgtctgaaaaattgaaagcaaccgtcaacaaacaagtcgcgaactggaccgttctatatgtgaagctacataattatcattggtatgtgaaagggaaagatttctttacgctgcatgaaaaattcgaagagctttacacagaagcggcagagcatatcgatgatttggctgaacgcctattggccatacagggctctccggtcggaacgatgaaggaatgcctggaaatgtccgcgattaaagaagcggacggaagcgagtctgctgaacaaatggtgcaaaatatttataatgactttttaacggtggctgaggagctgaaaagcggaatggagcttgccgatgaagtcaacgatgaaacgacgggagacatgctgctcgcgattcatcaatcgatcgaaaaacacaactggatgctgaaagcctacttagggtaaggaaaagctcgggcaatgcctgagcttttttgtgttttcgttctttttaaagccttttttagaaattgtcaaacaattcatccaagcctttcaaagtcttttttcataggataagctatgaaaagtcttttttgaaaggatgttgaagcatatgtttaaggacttaagcatcttttcgctctttacaattggtttatcggccatcggatttttgtttggccgaatcgaatatttatttatgatcttaattacgctgatgggcattgaatttgtcagcaaaagcttgaacgaatgtgtggaagatcgatttacaattaagaggctgtttacaaggctggcgaaaaaattggttacgctctttctgatatccgttgcccacctttttgatcaaatgctgcaaacaggcagttcgatccgcgatttttctattatgttttatattttatatgaagcgtttcaaatcgtgagcacggctcattcgttaggaatccccgtgccgcagatgttattggacattttaaataccataaaggaaaaactccggggaaagccgtaacattttaaaacaactggtcatactaacacgaaaaaggatgattggctttggaaaaaaagacatactatgtttcggtgcaagatggaatgatttcgcagagctctgacgcttccccgtgggaatttcaaatttcggcgacagatgatgacatcatcattttaagggaatattttgatcagctgtattcagaagactgggtcaactttttcagagctcacgtgcctgcggtcgaatatcacaatgacagtgcaaatgataaaatggacgaactgcgcaaagacatttactcgatgctttaccgtctgggcaatgaagaaaccaagtcatttatcagtgaaaacggccttgccgaactcaattcagcagattaaaaaatgctgcttttgaaaagcgcccgcaggcgcggagtcatccagccttgccgccttctcactcaggaatggacaatgaagttctttagggaacgataaaattactgaactgaactggacaaaaactctaccgaaagaaccaatatatgatatgatgagtggaagaagcaaggaaacggataagagggattaggatgtacgaatttaaagatttttaccgtaatacggttcagctttcttttgagaaggaacctttttcaaaagaaccaaagcatgtatgggtgatctgccgttacgaggatcaatggctgctgacaaatcataaggacaggggccgtgaattccccggcggcaaagtcgaaccgagcgaaaacgctgaggaagcggctttgcgggaagtgaaggaagaaacgggcgctgtcgtaagaaagctgacctatctcggacaatataaagttcttggcagggagaaagtgatcgtcaaaaatatttattttgccgatatcgaaaagatagaaaaacagcagacgtactatgagacgaatggtcctgttttgctgaagagcctcccgaaggatatcgcaaaaaacaaaaattacagttttattatgaaagattccgtcctgacgatcagtcttgaaaagctgaaaaaggccggcatcatcaaataaaaagccctgcatttgcagggttttttcatgttatactctgcctttcatccactttctttccaacagctcgacaccttgatacatcaatgttgcgaagacggcgatgatcaggaggctcagcatgacgaggttgaaattaaagacttgaaagccgtagatgatcatatagccgaggccttgagccgatactaaaaattctcctacgatgacaccgacccagctcaagccgacattgaccttcagtgtagatatgatcgtcggaatggaagcgggcaaaatgacttctttgaaaatctcgcgtttcgtagcgccgaatgttttcatcacttttaaatagttttcatcaatttcttgaaaggacgtatagacgacgatagtcgtaatgataacgctgatgatggcgcccattgcaataatgctcgtcaagctggggccgatcgcaacgatgagaatgggacccagcgccactttcggcatcgcatttaagacgacaagatacggatctaatattttggagagcctcgggaaccaccataagagggcggctagaaaagttccaagcaatgttccggccagaaagccgaggatggtttcaaatacggttacaccgatatgtcccggcaatgatccgtctcccattttttcgaggaaaagcgcccagacggctgaaggagagctgaagatcagcggatcgatccatgccagacggcttgcggtttcccacagcgaaaagaaaacgatgaaaatcgcgatttgaaaaaagcggacccgccttttttcggcctgctgctcctttaaaaaagcctcatgaaggaagtcaacttttggtttcggttgtttgttgttcaaggtcattgagctccttccatatgttctgaaagaggggctgaaattccggttcctgcctcgcttcaaacggtgtcagcttcctgatcggttcaggaacggcaaatgttttatggatagtgcccggctgctttgaaaatagcagaatccggtcgctcatcgctatcgcttcaccgatatcatgggtcacgagcaccgctgttttttgatacgtctttaacgtgttgaacactaaatcttcgaggttcaattttgtctgatagtcaagggctgaaaaaggttcatcaagcagaaggatatcggggtcgacagcgagagtgcgggcaagcgccgccctttgcctcatgccgcccgagagctcttttggatactttttttcaacctcgtaaagcccgaattttttcagcaggccgagagcggtttccttcgtttccgggcctagttttttggaaatgtgcaaaccgattaagacgttttcctcaatggttttccagggaaataaataatcctgctggagcatataaccgatgtgccgatcctttccatcaggtgtgcgcccttcaaccaagacgcgtccttccgtgggggaaacgatgccggcgatgatcgataaaagcgttgttttgccgcatccgcttgggccgagaaacgaaacaaattcgcctttttcgacttcaatgctgacgttttccagcgccgctgttttttccttcaatgaaaagtaagtatgtgtgacatcctgaacttgcagaaaagacactgcggccacctcctagtaattttttgtgaccttttcggcgatctttgtattgaccagcttttgatgaggggtgcgcttcggcagctcgccggcttcatccatgatggtttgaagctggttccattctttttcatccaaaacaggatcaagagcaaaagactgttgttgtttataccgttcgattgaagatgcaatgattgaaagctcggtatctttaaaataatcttgaatgctttcggctgcttcttttgcagagtgcgtctcaacccactgctgcgctttgtaaaccgcgcgggtgaacttttcgaccgcttctttgtttttcgttaaatagctttgtttggccataaaagttgtatatgggattcggcccgattcttttccgaaggaggcgacaatgcggccgatgccttctctttcaaaaatggatgcctggggttcaaataattgaacataatcacctgtaccagatgcaaagctgtttgcgatattcgcgaaatcaatagtttggatcagatccacatcctttttaggatcgatgcctttctgtttgaggacaaattcgcctgccatctgcggcattccgcctttgcgctggccaaggaacgttttgtctttcaaatcatcccagctgaaatgccccgaatcgttcctggagacgaggaaggttccgtccgtctgggtaagctgtgcaaaattaatcaccggatcgcttgcgccctgggcatttacgtatattgacgtttccgagccgacaagcgcaatatcggcgccgtttgacagaagggcagtcatcgttttatctccgccccaggtcgttttcagttcaacatcaaggccttcttctttaaaaaaaccttcagataaggcgatatataaaggcgtatagaaaacggaacgggtcacttccgccagacggatcttttcggtcttttgtccgccgcatgaagcgaggataaacagcatcatgatgaaggataatatggtaaaaaagaaacgcttcaaaccgatttccctcctttgatttcggttattttcggcataaaatagtttatgttatatactaaacaggtgtgagggacagctgcggattaaaagaggtgacgtgacgaatgtggatagaaaaaagaaggtttccatcgccgaacaaagaggtgcgtctgttttccgtcacatacctttcacaaggactcaaggttaaggggcttttggccgaaccggccgctcccggaaattatgacgggtttttgtatttgcgcggcggaattaaaaacgtcgggatggtcagaccgggccgaatcgtccagttcgcttcacagggctttgtcgttcttgctccgttttacaggggcaatcaaggaggagaaggcgatgaggattttgcaggtaatgaccgggaagatgcttttgccgcttttcgtcttcttcagaagcacgaactggtaaaggacggacgcgttcacatttttggcttttcccgcggcggaatcatgggcatcttaacggcaatcgaaatgaaagcagcggccgcttcgtttgtgtcttggggcggtgtcagcgacatggtcatgacctatcgcgaacgaaaagatttgcggcggatgatgaagcgggtcatcggcgggacgcctgaaaaggttcccgaagcgtatgaatggaggacgccttttgacgagctggagaagattgaagcgcccgtgcttttgatccacggagcaaacgatgaaaatgtctccatcgagcatgcgcggcgtcttgagcgtgaacttctgcgaaggaacaagtctgtggatacgtggtatttcagccaatatacccactattttcctccgcgcgaaaacaggcggattgttagagaattatcccaatggatgaaaagccgtccttggacaagttatggtaaactaaagtaaaagagaaaaggagggggactttaggtgggaatgacagttgaatttaacacgatgattgtgacaaaaggaaaagaaacgcgggttgaggaaaatgtgtttacactcgagaaagaaggttatcgggtttaccctcttcatgtgccgcttgaagtcagaaagaccaagcggggcgacattaccggcaccgcgcaggcggagcgccttgaatggtcagacggacggactcatttaacatacaggctcgtatcattaaattccacgaattaaaaaaagccaaggcgcggatagcgtccttggcttttctgtattatgcaggcacattttcctcttttccgattccttttttggaagtcagcctgtgaatcagcatggtgagagcgccgtctcctgttacgttcgttgctgtgcccaagctgtcctgggcaaggtaaagagcgatcatcaacgatacgctagtttcattaaagccgagcatcgactgcaacaatccggcagcggccatgacggcaccgcctggtgcaccgggcgctgcgaccattgtgacgccaagcattaaaatgaacggcatcatgaccgaaaaagtcggcgtttgaccgtttagaatcatcacgcccattgcacagcttgtcagtgtaattgtgcttcctgacaaatgaatgttggccaggagcggaacggcgaagtcagccactttttggcttgcccccgtttttctgacttgtctcagcgtaacgggaatcgttgccgctgacgattgtgtgccgagcgcggtgaagtatgccggtgctacgattttcaacagcgacagcggatttctgccgtttgcagcacccgcaacggagtactgaatcaagagtatgacaaggtgaagcacgataatcatcacgaaaactttcgcaaatacggatagaatcgtctgcacctgaccgccgaacgtcatattggtgaaaataccgaaaatatgaacaggcagtaacggaataataatatatgatatcagcttttcaacgatcgtttgaaattcatcaaacgcgttttttaatgtttttccgggcagataagcgatgccgatccccatgatgaaagcaaaaatcagtgcgctcatcacgctcataaacggcgtcatttcaatggtgaaaaatcctgcttgcagtacttcttccggatttttaaactcctgcagctgatggccggaaatgatcgcgggaagaaggtttgaaccgacaaggtacgccaggaggcctgcaaaaatggttgacgtgtaggcgatacctgccgtaatgccgaggatttttccggcgccgcggccgatttgtccgatgccgggaataataaaagcgataataataaaaggaatgacaaatttaatgaagcttccaaaaatatcattgaaagtagctgccgttttgacgaaccaaagcggagcaaagcttccgacgataacaccaagaacaattgccgtaatgatccttggcagtaatccaaatttcatagatgtgtcctcctgaaatatacaaatgtttttataatattaacatatgaaagatttcttttgttaaaaataaaaaaagtctgtattttcaaataataatacttgcaaattggaatcgttttatctgaggcggtgcttgactgtcatcttgatcattgtccaggaaatggcatcggccgctgataggcgaagaggttttcgataaactggatcagcgcagaagatctgcgctgatgcaagcaggctgagttaaacgagcggtcctccggctttttcgatgttttccgtattggagaactttttgaaattctgtttgaatgctttcgccaggtggatcgctttttcctcgtattcgttttcatctgtccaagttttggccgggtcaagcacttgatcaggcacacccggaacgtggaccggtgaatgaagtccgaaaatgcggtcagtcctcatttcggctttatccagttctccttctattgcggcctgaaccatcgctctcgtatatgcgaggctcattctttccccggttccgtatccgccgccggtccagcctgtattgacgagaaagacgccgaccccgtgctcatcgatttttcttccgagcatttcagcgtacacacgtgccggaagcgggaggaacggtgaaccgaagcaggtcgagaatgtggcttcaggagtggtgatcccgcgttcggtgccggcgagcttgcttgtatatccgctcaggaaatgatacatggcttgttctttcgttaacttgctgatcggaggaagcacgccgaaagcatctgcggtcaaaaatacgatggtctgcgggtgcgctgcgatgctcggcttgacgatgttgtcaatcgcgtcaatcgggtaagccgctctcgtgttttccgtgtagaatgagtcggaatagtccggctctccggttttgctgtcaaccacgacattttcgagaacggaaccgaagcggatcgcattgtaaatctgcggttctttttcttcgcttaagttaatgcatttggcgtagcagcctccttcaatgttgaaaacgcctgtgctggaccagccgtgttcgtcgtcgccgatcagcttccgcttcggatcggcggaaagcgtcgttttgcctgtacctgacaatccgaagaagagagcagttccgccttcctcgccaatgtttgccgaacagtgcatcggtagaatgttttgttcaggcagaagaaaattcataatagaaaaaatcgattttttcatctctccggcatattcagtgcctccgattaagatcgtccgcttctcaaacgacacgatgataaacgtttcagatctggttccgtcaacgagcggatcggctttgaaatgcggagctgaaagaatcgtaaacggctgttcttcaggttttttatcatgttcttcaggtctgatgaacaactgtcttgcaaacaggttgtgccaggcgaactcgttgacaacagtaatcggaagccggtatttttcgtctgctcctgcaaacccttcaaatacatacaattcatcgcgttcctttaaatagccgagcacttttgcgtacagccggtcaaaggcggcttctgaaatcggctggtttactgcgccccaatcgattttgtcctttgtgctcgcttcttccacaatgaatttgtcttttggcgagcggccggtgtatgtaccggttgttgcccgcacggctccggaagatgtcaagactccttctttgcgctcaaggatcttttcaaccaaatggggaacggataagttcatctgaacgttttcgcccgttaatagcgtttgtaagtcagttgttaaatctacagaattcataaaaaaccttcctttgcgtgttttttaatgtgtataacattaatgtagaattagtataacacatttactcttatagtctataccgtttcttcatttttcgttcgggttttttctcgtaggacaagttcaaatttatttcggccgatattgacataacaagccattttaagataagatatttcattgagcggatactcttatcccgagctggtggagggacaggcccaatgaaacccagcaaccggtttctcttattaatggaaaaaaacagtttctgagacaactacggtgctaacctgatgcaaggtgttcaataccttgagcgataagagtgaaaggcacgcaataccagaccctttcctcaccgaataggaaaaggtttttttattgcataaatcgagatccaaaaattgctaaaaaaactgccttcaggaggaaggtactgggcgtttttcacaggacgtgaaaggttttagccgagtatcaagcaggaggaaggtactgggcgtttttcacaggacgtgaaaggtctagccgggcaaccagtcaggaaaaattctgctaaggggaatttcgactcagaatctcgtcaagaatagcataatggaaattgtttcaaaacgagagcgtatgaagcccgagtatcgtcatataatcaagagggacgagttccgtatcatacttaagatcacggctgatcttcatatacaggaggaaacataaatgagcaaaaaccgtcggttatttacatcagagtcagttacggagggacatccggacaaaatttgcgaccagatttcggatagtatattagacgaaattttaaagaaagatccgaatgcccgcgttgcctgtgaaacatctgtgacaaccggattggtgctggtaagcggtgaaatcacgacgtccacatacgtcgatattccgaaaacagtccgcgaaacgattaaagaaattggctacacacgtgcaaaatacggttttgatgccgaaacttgcgcggtcttaacgtctatagatgaacagtctccagacattgcaatgggagtcgaccaggcgcttgaagcgcgtgaaggagcaatgagcgacgctgaaattgaagcgatcggagccggagaccaaggtttaatgttcggttttgcctgcaacgaaacaaaggaacttatgccgctgccgatttcgcttgcccataaattgtctcgccgtttgacagaagtccgcaaagaggaaattctgccgtatctgcgtccggacggaaagacacaggtaaccgttgagtatgatgagaacaacaagccgattcgcatcgatacaatcgtcatttcgactcagcatcatcctgagatttcgcttgaacaaatccagcgcaatctgaaagagcacgtcatcaatccggtagttccaaaagagctgatcgatgaaaacacgaaatacttcattaatcctacgggccgttttgttatcggcggaccgcagggggatgccggtttaacagggcgcaaaatcatcgttgacacctatggcggctatgcccgtcacggaggcggagcgttttccggcaaggatgcgacaaaggttgacagatctgcagcttatgcagcgagatatgtagcgaaaaatatcgtcgccgcaggccttgctgattcctgtgaagtacagcttgcctacgcgatcggtgtcgctcagccggtgtccatttcaatcgatacattcggtacaggcaaagcgagtgaagaaacattgatcgaagtggttcgcaaaaactttgatctaagacctgccggcattattaaaatgctcgatcttcgccgtccgatttacaaacaaacggcagcttacggacatttcggccgcctcgatctcgatctgccttgggagcgcacagacaaagcagatcagctgaagaaagatgcattaggagaataacaaccgcatagccgctttaataagcggctttgtttttcgatggcaaaatgcgggcggatgttgaaacttgaaaaatatccagatttaatattgatgtgatattgccagatacaaatattttaatatgaacatttttcaagttacttgaaacgtttttctttaaacacttgtctaatcaagaagcagactttgatttctgcacgaaatttaaaaaatcggaggcaatactatgtgtggatttgtaggggtattcaatcatcgcccatcatccgagacagcagcacaggaagaactgattaaacaaatgaatgaaatgattgtacaccgcggtccggacgatgatgggtactatcatgatgagcatgtaggcttcggatttagaaggctcagcatcatcgatgtggaaaatggaggacagcctctgtcttatgaagacgactcctattggattatttttaatggagaaatctataactatatagaactgaaagacgaacttctttctaaaggatacgagttcaaaaccgattcagatacggaagttttgcttgcgacttaccgccactacaaacaggaagccgcttcaaagctgcgcggtatgtttgcttttttaatctgggataaaaaagagcagcttctatacggagcgcgcgatccgttcggcattaagccgctctattttacgaaaacggacggccacgtttattttgcgtcagaaagaaagagcctgatggctgtcgatgctgacttggaattgaatgaaaaagcgcttcagcagtatacatcgttccaattcgttccggagcctgagacgctggacaaaaaggtgcaaaaagtagagccgggccatcagtttaccgtccgcccgggtgaggatattcaatttaaaacatactggaaagttcaattcaagccggttcagacagaagaagacaagcttgttcaggaagtaagagacgcgatctttgattctgtaaaagttcatatgcgaagcgatgtgcctgtaggttccttcctttccgggggcattgactcgtcctttatcgtgtcagtggcgaagcaattccatcccaacttaaagacgttctctgtcggctttgaacatgaaggcttcagcgaagttgacgttgcgaaagaaaccgctgataaggtcggcgtggaaaacttcagcgcgatcatttcccctgaggaatatatgaacgagcttccaaagatcgtctggcatctggatgatcctctggcagaccctgctgcgattcctttgtattttgtcgcgaaggaagcgaagaagcaagttacggttgttttgtcaggagaaggggcagatgagctgttcggcggttacaatatttaccgagagccgctttcattaaagccgtttgagcggatcccgtccccgctgaaaaagatgcttctgcgcgtagcttcagcgatgccggaaggaatgaaagggaaaagctttttaatgaggggctgtactcctcttgaagatagatatatcggcaatgcaaagatttttgaagaaggcatgaaatcaaaacttcttcgccaatatgacagcaacctgtcttactgtgacgtgacaaagccatattttgaagaaagcaggtcctacagcgaaatcaataaaatgcagtatgtcgatatccacacatggctgcgcggcgatattttgctgaaggccgacaaaatgacgatggccaattcgctggagcttcgcgttccgtttttggacaaagtcgtatttgaagcggcttccaaaattcccgaagagctgaaaacgaaaaacggcacgacaaaatatcttcttagaaaagcggcggaaggcatcgttccagaacacgtgctaaaccgcaaaaaactagggttccctgtgccgatccgccactggctgaaaaacgaaatgcatgactgggccgtgaacatcattaaagagagcgagacagatgcatatatccataaagattacgtgctccagcttcttgaagaccactgcgccaacaaagcggataacagccgcaaaatctggacggttctcatctttatgatctggcacagcattttcgttgaaaaacgctttgtaccggaagagctgaaccatcagccaaaagaggtcattattgtttaagccaaaaaaagaaggttttcgattaaacgaaaaccttctttttttatgccggtttttctgcagataaatctgcaagcacgcttttacattcggagaggagattgtcaaagatcacgtcccacgactgggtaagggcatagcttctcgcttcgtatgccatccgtttttttaacgatgggttggagaggacgcgcaatatatttgcggtgaatgcttccggatttctaggttcggaaagaaaaccgtttcttccgttctgtataaaatctttcaggccgccggagtctgccccgataacaggcgtcccgcaggcgagcgcttcaagggcggaatttccgaaggtttccgtcggagaaggaaagacgaacaaatctgagctcgcatagatgcttgccagctcttctcctttgacatagccggcaaaagtcatgttgaggggagctcgcttctcaagctctttttttaacgggccgtctccggcgatcagccagtggacgtcatctttcaaagcggggtgacttgcgaccttgagcagcgtctccaagtctttttcaggtgcaagccttccgacatagctgaggatataggtttcctttatgccgtatcgcctgcggatgtgttcggtttgatgcgccggactgaactgcgagcagtccacgccgcgcttccagatggagaggttcctgaattgtttggctttaagctgcataaatgtttcgcgcgaaggcacaaaaacttttcgaaaatctttatgaaaccagagcatatatttccataagagtttggaaaacatttgaagatcataatatgaaaggtactggtcaaaatcggtatggtaagagcctacgacggggatgttccatttcttcgcaagcttgagccccgccaggccgatattaaaaggagtcgcgatgtgaatgagatcgggatggaattcgcggagttctgatttcattttgatgagattaggaagagcgattctgcactcggggtataagaagaacggcatgctcgtaaaacggcggatgcggctcgaaaattgtgtttcatgcgtgctttccggcgcaaatactttatagggcatcccgtttttttcaagataatccgtataccttttcagcgttctggcgcagccgttcacatctggtgtgaacgtgtccgtaaatatcgcaattttcatcgtttcccctcctgtttgtgtgtgaaaaatcagtgacgctttggaagaaacggccggcttagaagatcatcgccgacaaggttccgactgaaatcccgagggctgtgcctgccagaacatccgatggataatgaagaccgagataaatcctggagagccccacactgacgccaaccggtattaataaaagcgcgagtatcggaaagaatatcattaacggtgtaataacagaaaatacagctgtcgtatgtccggatggaaaagaatgatccttgagcggattttgcaaaacctgagtttcctttagcgttaaatacggccgctttctcggatacagctttttgatcagcatgacttgaaggtggctgaccaaaagtgcaagggcgctggccatccccgctgtacgaacacttcccgagccgaacagcaagagagacaggcaggcagaaatcgtgcacatagcccctcccaaatgagttgaggaacgaaaataacggttgagtgttttttgatgaaataatctgttcataccgaggaaaatccggcattcaaagttgtaaatgccaaccatcagtttattcaaatgtcctaaccccctttacatgtatggctgcttcattttttattgtaaaaaatgaatgtttagcaaatgataagtatttgtaaagatttcggaaaaagaaaaaagccgcagacgcgtgcggccgaaaaggtttttgcttaaattatcggtggaaaaatggtaaagttgtagcaaagctaatcttttttttgcaaggatttgtagtattgtcctttttcaatatattctttgcgtattctttccatttcctgtttatctttgtcggttaacggacggatgactttggcgggcctgccgaatgcgaggtgcccggacgggatctttttgccaggcgggacaaggctgcccgccccgataaaagcgccttccccgatctccgcttcgtcaagaataatcgaccccattccgataagggcatgctttcgaatcacggagctgtgcaatgtaacctgatggcctaccgtcacaccgtcttcaatcacgagagggcgttcagggctttggtgcagacaagaaaggtcttgaatgttcacaccttttccaattctgaccggggcgacatcgccgcggataacagaagagaaccagatgcttgatcgctctccgattgttacatctccggtgatgaccgcgttgtcggcgataaacgccgtttcatgaataacgggttccgtttttttataagggtagatcataggtttcatcctttcatttataaaattgtgtgaggtggtcagcatgtggtgcatggaagcggaaagacctgttgctacaatcgtcgtcattcacggtgcatgtgagcatcacgggcggtataaatggctgtccgaaatgtggcgttcatccggctttaatgtcgtgatgggggatttgcccggccagggcacttcgacaagagaaagaggacatatacgctcttttcaagaatatattgatgaagtggacaaatgggtcgccagggcgaaagcatttgaactgcctgtgtttatgctcgggcacagcatgggcggcctgattgcgatcgaatggtttaagcagcagcaaagcggcattgccggtctcattttatcatccccttgtctcgggctgcaattaaagccgaacaaatttctggacttgatttccaaggggctcaacgttttggcgccgtctatgcggtttgaatccgggatcacgcctgataaagcgacgagaaacaaagaagtcatcgaaatggacatcaacgattcattatatatcacaaaagtttctgtcagatggtatcaagaaatgttaaaagcgttgaaaagcgcgatggagccgacggacgcctttctcaacatcccgctctttgtcatgcaggcgggcaccgactggcttgtcgacaaaaaaatggtcgtcaagtggtttaaccagcttgcttcccacaataagacgtacagggaatgggatggcttgtaccacgaaattttcaatgagcctgaacgggaagacgtttttaaagcggccagagcgtttgcggagcagtatataacataatggaggtgcattctttggcagtaccggagcatccttttggattaatggctaaagtatacagagaggtttttccccttgttcatcaggaattggacaagtggaaacgaaaagctgaaacgattcaaaatcccgaactgaaaacgcaggcgaaagccagcatcagggataaaacctttcactgtgaaggcggcggcattatggcccttctttcaggagacaaaatcgagcagtcgatccggtttattacggcgtatcagacgataagcgactacctcgacaatctatgcgaccggagcacctcgcttgatccggatgatttcaccatgcttcaccagtcgatgaaagacgcgctgacagtcggggctgaattgaaaaactattacaggttcagggaagatcaggatgatcaaggctatttgcacgacttagtgaaaacatgtcaaggcgtgcttgcggaaattgagaactatgatctgatcaaggagcatctgattgagctttgcagctactattgcgacctgcaagttcataaacacgtagtggagcatgagcgtgttccccggctcgaagcgtggtttgagaattataaatcggctctgccgaaaatggaatggtatgagttctcggcctgtgcgggttcaacgctcggcatcttctgcctcgtatcgtattccgtccgtcccgattttactgaatcgatggccggaaagatccgcgacagctattttccgtacatacagggactgcacatcctgctcgattatttaattgaccaggaggaagatttaatcggcggggatttgaatttctgcacttattacccatcacattcagatatgatggaaaggctcgaatatttcatcgaaatggcggatgaacatttgcgcgggattccgcacgaaaactttcaccgtttgatcaacagaggactgttaggcgtttatttgtcggatgacaaagtagcgggccagaaggaaatcggccggcttgcgaaaaagctgattaaagcgagcggcaaaacatctttctttttctatattaacggcagggcataccgcaaaattcaaaaaatgccgtggatgaaaagctcgtaaagaaaagctcaaaccgtttatcggcttgagcttttgccgtttataagctttccgtccggtattgtttttcaagcacaaagcgcttattataccggaagcttttttcccatttagaaacaacgatgcaggcgacagcatgacccggcacgttcacgcctgttcgcgccatgtccatcacgcggtccactcccgcgataatcgcgactccttcagcgggaaggccgactgcgttggcggtagccagaaggacgacgagcgagccagatggcacggcggcgatccctttgcttgtcatcactagcacgagcatcatgagcaattgctgggaaatgctcatgtctatattgaaagcctgcgccaaaaagatacaggcgaccgataaatataggctggagccgtcgcaattcagagataagcctgaaggaaccacgaaggaaacgacccgttttgggcagccgtatttctccatgcggtccatcagctgcggcaagactgtttctgtgctcgtcgtggagaacgcgatcagaaacaaatcccaaatcattttcaggacttcgaagtatttaattttaaaaacaagaccgacgatcggaaataaaacaaaaagaacgagaaacagtccgagaaaaacagtgccgactaattttaacataggaagcaggagctcgatgccgtattgcccgacggatgcggccataagagcaagcacgccgataggcgctgtgaccatcaccatctgcgtcagcttgaacatgatgttggcaacagattcaaaaaacttcatgacaggttccgaggctttgccgatcccggcagctgcaacgccgaacaatatcgcaaagaagatcacggcgagcaaatcatttctggccatgacgtcaacgatgttggtaggaatgatatcgaggatcatttgtttaatatcgaccactttttccgtgtagcccgagagttcgtcgatatcctttttggccaaatgggaaaggtcaaggccgacgccgggctttaacacattagccaaaagcagcccgagtccgagcacgaacgtcgtaatcacttcaaaccaaataatcgtcttgatgccgaggctgcccatttttttcatgcttccgcttccggccgctccgatgacaattgtagaaaaaacgattggaacgacgatcattttaatcagacggataaatccgtctccgacggggcgcagcgccattccgaaatcagggaagaaatgtccgataactgctccaatggcgagtgcgatcaaaatttgataagcgataaattttttcaaagcgaaatccctccgtattttccatgagttttcaataatttcgcgacaaagagtgaaaccacctccattatttggtgttttttagaaaattccgaaatctaaagtgttcatattttattttgatatcgcttacattatgtttgaatgaaaaaaatcctccaaacggaggatttcaggctgtcacttttggaccgcttctttcttttcgatcgcaatgataaacggcggatcgtttcgctggtttaaatattggtaacagaggacacgggccgtatcctggtcgagcgatgcacaaaattcgagcagggcgtctttttcccgctttccttcgggatggccatggtagacgacaagcacgatcagcccctcatttttcaggattttgagaagctgcttgatgctggcgatggtcgaatcgctttttgtcgtcaccgatttgtcgcctcccggaagatatccgaggttaaacacggctgctgccaccttgcctgagatgtcgtcaggaagcgaagtggtgagctcatcatggcttttttgaatcaatgtcacccggtctttatactcgtttccaagtctttcggcagtattcataagagctgcttcttgaatgtcaaaggcatagacatgcccgctttcaccgacaagttcagctaaaaagtgagtatcatgtccgtttcccattgtcgcatcaatgacgatgtctccttcgcctgcggctgttttcagcagttctttcgcatacgggaggattttcttgagcttcatgtggccatgccttctttcgccttgttgaaccatttcccctgatggctgccgcgcctttccaattccccgttgatggcgtttaagacttcccatttattgacgctccacatcggtccgaccatcaattcgatcggtccgtcacccgtaatccggtgaatgatcatttccggcggaagaatttcaagctgatcgcaaacaagctggacatattcatcttgagaaaggaacgttaattttcctttttcatactgcttcaccattggtgtcccttttaacaggtggagcagatggattttaatcccctgcacgtccaaatcggcgacggcttttgcggtttccatcatcatgccgcggtcttcgagaggcagtccgttaatgatgtgggagcagacccggatgccgtgtttcctcagcttgttcacgccttccacgtagcagtcgaaatcatgggcgcggttgatcaaatcagccgtccgttcatgaacggtctgaaggccgagctccacccagaggtatgtgcgttcattaagctcggcaagatattcgacaacatcgtcaggtagacaatccggccgggtagcgattgaaaggccgactacgccgtcaaggccgaggacggtctcgtatttttcgcgaagaacgctgacgggagcgtgcgtattcgtaaatgcttgaaagtacgccatgtatttgccgtctttccatttttcatgcattctgtcgcgcacttcattaaattgggtaatcagatcgtcggcgcggtttcccgcaaagtctccgctccctgcggcgctgcaaaatgtgcatccgccgtgtgcgaccgtaccgtcgcggttcgggcagtcaaagcctccgtcaagggcgactttaaacactttatgaccgaaatgatttcttaaatgataattccatgtatgatatcgtttttcactgttcgtatatggaaaagggttgttctgatgcaaacaaaaggacctccttttagtatcacgcatcctaaaattgtagcaaataaacacgataagaacaaaccgattcccaattattttcttcaatgatcacagctgtgatggccaaactaatcacgatggatttttccattaaggaggggttttctttggctacaagacaatccgtcggagagcacatccaaagaagcgaagatgcttatgattatgctttatctcaatttgaaactgcaagcaggcaggaacattacaatgagacagagtacagcgatgcgcagctgatgcttgaaaacgcggtcaatgaattaaacaagctttcgctgtttgccaatgagcagcaaagggaggaaattcaccgcaaaaggctccagctgcaaacccttcaaaacaatatgattctgcagagatcgtatgaaagatgaaccctttttgaaagggttcatttttttgaaaaaagcgattgacaaaaaaggacgatgtctatattgtattaagtgtactacatcaagtaatacagttaacacacacatgtaaaggagcaatactcatgagtgataaacataaaaaagtaacgccaatggttgtcgtggcgtttatcattgcctgttcgttcttgtttgtacttgcgaagctgggctttatgattcaagaaaatttgggatatgtgtttttttaaaagtgaataacgctgagattgaacgagaaagaagggagatagatgattcaaatcgatccgagaagctcaaccccaatctatgagcagatcatccagcagatgaaagagctgtgcttaaaagggataatcaagcctggagataaacttccttctgtcagagagcttgcaaccattatcattgcaaacccgaatacggtcagcaaagcctataaagaacttgaacgggaagggattattgaaacgttgaggggaagaggaacgtatatttcagaaaacgcgaaagttacgcttgatgaagggaagattgcgatgattaaagagcagttaaagcagctgatcatcgatgcgcattacgcggggatcgacaccaaaaagctgcaggagtggatggcggaaatcgacgaagaagtgagaggaggcgaagtgaatgattgagctcaaatctgtttcaaaaacgattgacggaaaacaaatacttaaagacatctcctttaagctggaggaaggagagattttcggacttctcggaagaaacggctcaggaaaaacgacgcttcttcgcctgattcagcaaatcctgctgcctgatgagggagatatctttttcggcagcgtcaaggtgaaggatcatccgctcgtcaagcgcaacatcgtctatatgcccgttcaaaacacctatttcgaaaaatacaattacaaacagctcgtcaatattttgcgtaacatttatccggactttgatgttacatatgcaaatgaattaatgaaccgatacgatattcccgaaacaaaaaagtacagggaattgtctacaggattgaaaaagcaaatgtcgctgatcctgtcatttgcgatccggccggcggtcatcctgcttgatgagccgacagacggcattgatgccgtcacaagacaagacgttcttcagctgatggtcgatgaagtggctgaaaacaacacgacgattctcatcacatctcaccggcttgaggacattgaaagaatgtgcaaccgaatcggttttctcgaagacaatacattgtcgaacatcatggatcttgatgaactgaaaggcgattttattaaaattcaaatggcatttgaagaagatgtcaatttaaaaatcagggaaagggaaatccctgttttggaccacaccggcgtcttttatacggtattggttccgaaagaagacaatgtgagcaaacaatttcttaaaagtttgtctccgaaagtttggaacgagcttccggtcaatcttgaggaagtattcatcgcgaagtatggaggtaagcgaagatggtagaccgcggacttttatataaagaatggaaacagcatttctggatttttttagttgtttttgcagcggtgttgctgagtgaaccgcttgcgattttgaatgattatttccagtaccagggatgccttgcagaacagaaaaaatttcccgatatagagtgcgttttatataaagattatggggtaagcggggccatgagaatgttctgggttggcggagtcgcgcttgcgatcagccagatcgggtttgaacggagcagaggaacgcttgactttacactcggcctcccttacaagcgcggcgtcattttcaatactaaatatttcttcggcatttcaattcttttaacagcccagctattatcttacttgttatcttacgctttgattattttgtataacgttgacgttgtctttttccatgagtattttatcggggcggttatcttctgctttatggtctactcgcttgtcatggcggcgggcgcgatgaccggcaatccgctggcccagatgatcgttgctttttcagcgtcgattctgccgtatttgctgatcggccttccgctggccaacttacgaatcatcctgggtttctttgggcatgaccctgctttcttttatggtgaaacagaactactagattatataacgccgatcatatacctcaacagtttcggcattcaagacggcagcctggcctttacgcttattccgctcgccatggggatcttgttttatataatcggctatttctgctttatcaaacagcagcttgaacggaacggacattttttcctttggagaaaaatggatcgtccgatccagattctcgtgattttattcggcatctggggattcggcacagccgctgcttcgagtctgttcagctatatattcggtatgttgatcggttcggcagtcggatttttaatcagttacttcttgattttcaaaaaaataaaacagctgtaatcattaatggagaggagatttacaaatgatcagtgtaaagcatattcaccactcgtttaaagtcggcaaaaagggaagggaaaatgaaattaaggtgttaaaggacgtctcgcttaccgttgaaaaaggagaaatcgcctgtattgtcggacggagcggctccggaaagtcgacactgctgaacttgatttccggctacatcgccccgacaaaagggaagatcatgattgacggcacggatgtcacgaagtacagcgagaaagaatgggccgcattcaggcttgaacatttcggcttcatctttcaaagttttcagctgattccgagcttgacgactttcgaaaatatcgaacttcccctgactttaaaaggtgttcatccgtcggagcggaagcagcgcgtcaacgagatgctccaccgcgtcggccttgaaaaccacgccggccactatccgaatgagctttcaggcggacagcagcagcgcgtcagcatcgcccgcgctttgattttgaatccttcaatcattttagccgacgagccgaccggaagcctggattccgaaacagagcaggaaatccttgaattcattcggcagctgaacagggaacgcggcattacatttgtcatcatcacgcacgatgacgaggtggcatcgatcgccaatacgaaatttcatttatctgacggcgtgttagagaaaggggaagagactgttgaagtttaaggaccagttgaagttcattagaagaaatatgaagaaaaaccgcctgcgtgtattcatgaccattctcgcaacaacggtggcctgcgcgtttttaatcgtgctcgcatcggtcggattcggactgcaaaaatcaatgactgaacagctgatgaaagagcagatcgtgaccgagataaatgttgtcggaaaagaagggcaaagcgatcaaaaggttcaaaagaaagacctgaaagaatttgaaaaccgcaaagatgtgtccgcgattatcgagcgcacaaacgtgttcgcacctgctgaagcaaaattgggcaacaggaccaataatcaaatgtcgaatattacaattaccgacatggccgctgagcaaaaagccaatatcaaactcgatcgcggccgcgtagcgaaaacaccgaatgaaattgtcgtcggctaccatttcgggaagaacctctggacgaaaaaggaagccgcagattatgaaaagcagatggaaaataatgctgaggaagcaaaagagccgaaaggatacgaagaagatattctcggcaaaacgattgaattaaagatctcaaaaatggatgaaaaaacaggagaagaaggggaagcgaaaacatatgatctgaaagttgtcggagtgacaaaaaaaccttcgtatgaatgggcgagcgattcaacagtctatgtcagcaacggcatgcaaaaagacatcaccggctttctgaagtcggaaaaagacagcggcatgatcgaaaaaacgctttcggtttacgcggataactttgaacatgtcggacagctgacaacagatttggaggatgaaggctactacgtcgattcaataacgaaaaagctcgatagcatcaatctttttttcatggcttttaaaatcggtctgatctttgtcggagtcattgccgtcttgatttcagcgatcgggattttcaacacgatgacaatggcggttacagagcggacgcaggaaatcggcattatgaaagcgatcggtgcaagcccgaatgtgatccgaaaaatgttcctgctggaaagcgcctatatcggcatcttaggatctgttttaggtattatcatttcatacggtgtcagctttttagtgaacaagattatacctgtcattttatcatcggtttcagaaggagaagcgagtgcggcagagctcagtatcaccttctcgcatattccggtcagtcttgtcctcatcgcgacattgatcagtgcgggtgtcgccattctttccggcctgaatccggccattaaagcgacaagaacgaacgtgctgacagcattaagaagagagctttaggaaaaaagccggcggtatgccggctttttaacgttttggcggtctgtaccccgcatcacgcgcctcctgttctgtgcagaaccagcgagcgacgtttttcgtgcggtcataatatgtactgcccggtgtatgataaatatggttgacgcttcctttgattttgcactcctgtttgctttcagcgctgcttttcttggcggcgggcgtgctgtgtgacgcttcggcctgagcggcggcgctcttttcttttacagaggtttcggcactgccgcttttttcttcagccttggccagtttttctgtcagcgattttgtttttttcgtaagcgaatctttttcttttgtcagtttttcgttttctttttttaatgtgtcattctccgctttgactgccttcagttttttgtttgcctgtttgacctgctgctttaatgcggtttgctccttttgcaaagcgctgtgttcagttttcagttcctgaagctcggttgtcagatcctccgtttttttctcatcggcggcatatgtttcctcatcgtaataaggtgcagagatgatcaggaggagaagtccgccggcaaaacaaggataaaagagtttcctggaaaaccttttgcctggagaaaaaatccttctgatcaaatgaaatacaagatagcagatggaaaaaaggaaggataaaaacccgatcagcatgatagattccatgattcgtctcctttcttaattgataactatattttagcttaaaaagaaaaaaatgtttataccgaaaaaacttcttgcaaatctaaatattcaaacgtaaaataaagaaatcatttaaaaaccgaatatgcagcttataaagagagatggagggactggcccggtgaaatctcagcaacctgcagcagtgcaaggtgctaaatccagcagaatgtcaggcgcattctgaaagataagttgaacaactctttcaggcggctgaaagagtttttttattttgaaggaggagatcaacatgaacaagttattaaaatggacttctgcgctgggactggccttgagcctggcgcttctggccgcgtgcggaaacaatgccgcaagcgacggcaaaacgatcaaaataggcgccactgcaggaccgtattacgatatggtcaaaaaagcgattcaacctgagcttgagaaaaaaggctacaaagtggaggtgatcgaattcaccgattatgtacagccgaatactgcgttaagtgaaggcgagctcgacgcgaatttgtttcagcatgaggtttttatgaaatcatacaatcaagaaaacaataaaaatcttgcggctctcatttctgtgccgactgctccgatggggctctattctgccaaatataacgacttgaacgatgtcaaaagcggagcggaagtggctgttccaaacgatccggccaatgctgccagggcatttttaacccttcaggatcaggggctgattcggctgaaaagcgatgtcgacacattgaaagcctctgtgcaggacattgcggaaaatccgaaaaagctgacatttaaacagcttgaatccgccaatcttccaagagctgtcgatgacctggatatcgcggccgtcccgggaaatttcgctctctccgccaatatgaagctgcaggacgccctagcgcttgagaacatgcccgaccgctaccgcaaccaagtggtagtggatgaaaaaaacaaagacaagccattcgccaaagatctcaaagaagcggtaaaatccaaagctttcgaggagacgatcgatcgggaattcgccggtttcggaaagccgaaatggatgacgcaatcataaaaaaattccccctttaaaaagggggtttttatgttgaaaatcgaaaacgtgtcaattgaaaaaaatgggcaaaacgaatagaatctagagggaatgataaagagaaagaaggaaacgctatgccgcgcacattatggcttttggtcatcggaatgtttatcaatgtcacgggggcatcttttttatggccgctgaataccatctatatccatcagcatttgggaaagtcgctgacagcggccggatttgtgctgatgctgaactcaggggcaaatgtgctgggcaacctgttcgggggatatctattcgataaaatcggcggatttaaaacggttgttcttggaattgtgatcacgtttgcgagcctttctggcctcgtcttttttcacgattggttccagtacattcttttcttaacgttggccggttttggatcagggatcgtttttccggcatgctatgcaatggccggatcagtttggccggaaggcggcagaaagccgttcaacgctgtatacgtggcccaaaatgcaggtgtggcagttggctcagcgctcggcggaattgtcgcttctttttcatttacgtatgtttttctcgcgaatgcgatgctgtacgccgtcttcttcatgattgcgtttttcggatttaaacgcatccggtctgaaaaagccatgcagtcatctgttttggatcatgccgattcagtcagcgggaaatcgaaattttctgcgcttttggtcatatgtacgggctacctgctcggctggatcgcttattcgcaatggtcctcgaccatcgcttcacatacccaggagctggggatatctcttgggcagtacagcgtgctttggacagtgaacggggcgctcatcgttttcggtcagccgctgatcggtttttttgtgaaacggtttgccgaatcgctgaaaaaccaaatcgtgatcggatttgtcatttttatgatggcatacggaattttgtttggcgctgaacggtttccggcttttcttgctgcgatggttgtgctgaccattggcgaaatgcttgtatggccggctgtgccgacgattgcaaaccgtctcgcaccgagagggaaagaagggttttatcaagggtttgtcaacagtatggcgaccggcggaagaatgatcggaccgctttttggcggaatgctggttgattattttagtatgcagcttttgctcgcggttctgctcgcattgctgctgattgcaataggaacggcgtttttatacgacaggaaggaaaagcagctctccgctcagtcagatgcatgagtaatatagaaaaaataggtaattgtaattattcgaaaatgaatcgaaggaatcaagattatcaaccaaatcttcacatataatggaagaaacaagctttttttcttctcagacagaacacattttctgtatggtagtatcgaatatcatcgcaaggggtctaggggggctgctcgatggcctgaagtcgcttgactaaactaagggctttaggaaggtgatgaagatgctgcatcaagttttggttgcttgtttgattggagggattatgggggttctcgggcacgttaaaaaaagaggacgactcgagaaaccgagaacaacgaaacgattcatttaccttggattttttgaagatattcttgtcggaatggttgcttctattttgcttgttttatctgcggaacctgattcgggaattcagcttgtcgtgttatcgatcattgccggctacggcggtgaagctgtattgagaagctttgactttgtcagagaacagcaggcaaatgtacagaactccgaacggcaaaacaaatctccacacgattaagatcctcactcttacccttttttcagcacattcccattgtatacaaacctgcttgcacttatgaacagaattctataaaatacagataagattacggttacggcaagaacagtgaagaggagcagtaagaagcccattttgtttcagagagttgacggctggtgaaagtcaatcaaatgagcttccgaactcgcctcagagttgcagcagtgataagctgctgccgcgtatctgcgttacagatatcaagtgagtgtgccgcgtgcacactaacaagggtggtaccgcgggaaatctctcgtcccttcttagggatgggagagtttttttgattttagaataatctgaatataacgctgccagtcccgtccatacttgaagacaaagaagccgtacacatattcaaaggaggtttttacaattgagctttgaccatcaaacaatcgagaaaaagtggcaggactattggctgaaaaataaaacgtttgccactcgtgaagataaatccaaacctaaattttatgcattggacatgtttccgtatccgtcgggcgcaggccttcacgtcggacaccctgaaggctatacagcaactgacattttgtcccgcatgaaacggatgcaagggtacaatgtcctccatccgatgggctgggatgcattcgggcttcctgccgagcaatatgcgctagatacgggaaacgatcctgccgtcttcaccgagcagaacattgacaacttccgccgccagatcagagcgctcggcttttcgtatgattgggacagagaagtcaacacaacagatccggactactataaatggacgcagtggattttcttaaagctttacgaaaaaggtctcgcttatgtagatgaggtccctgtaaactggtgtcctgcgcttggaaccgttcttgccaatgaagaagtcatcgacggcaaaagcgaacgcggcggacatcctgtagaacgccgtccaatgaagcagtggatgctgaaaattaccgcttatgccgaccgcctgcttgaagacctggaagaactcgactggccggaaagcattaaagaaatgcagcgcaactggatcggccgttctgaaggggcgcatgttcattttgcggtcgacggcaccaatgaaacgtttacggttttcaccacgcggcctgacacattattcggtgcgacatatgccgtgctggctccggagcatgatttggttcaaaaaatcacaacgcctgaacagaaagacgcagtcaacgcctatattgaagaagttcaatcaaagagcgacttggagcggacagaccttgccaaaacaaagacaggcgtcttcacaggtgcatatgcggttaatccggcaaacggagaaaaaattccggtctggattgcggactatgtcttggctacatacgggaccggggcggtcatggccgttcctgcccatgatgagcgggaccatgaatttgcatcagcattcgggctgccgatcaaagaagtcgtcaaaggcggggatgttgagaaagaagcatatacaggcgacggcgaacatatccattcagattttctgaacggtcttgataaagcggctgcgatcgaaaaaatgatccagtggcttgaggaaaacgggaagggcgagaaaaaagtaacataccgcctccgcgactggctgttcagccgtcagcgctactggggcgagccgatcccgatcatccattgggaagacggcacatcgactccggttcctgaagaagagctgccgctgatcttgccgaaaacgtcggaaatcaaaccgagcggaacgggtgagtcccctcttgcgaatattaaagaatgggtggaagtgacagatcctgaaacaggcaaaaagggaagacgcgaaacgaatacgatgccgcaatgggcgggaagctgctggtacttcctgcgctacattgatccgaagaacccgaacgagctggcttcccctgaaaaattaaaggaatggcttcctgtcgatatgtatatcggaggggcggagcacgccgttcttcacttattgtatgcgcgcttctggcataaattcctttatgacatcggggtcgttccgacgaaagagccgttcaaacagctttataaccaagggatgattcttggcgaaaacaatgaaaaaatgagcaaatccaaaggcaatgtcgtcaatccggacgaaattgtggagacgcatggcgcggacacgctccggctgtacgaaatgttcatgggacctttggatgcatcgatcgcctggtcaacgacagggcttgacggagctcgccgcttccttgaccgcgtatggcgtttgtttatcgatgacaatggcgggttaaacgagaagatcgttgaaggagccggcgaaacgcttgagcgcgtctaccatgaaacggtcatgaaagtaacggaccatttcgaaggtctgcgctttaatacaggcatttcacagctgatggtcttcatcaatgaagcatataaagctgatcagcttccgaaagaatacatggaaggcttcgtgaaattgctttctcctgtcgcgcctcatttggctgaagagctctggaaccgcctcggtcatgaggaaacgatcgcgtatgaagcatggcctgtctatgatgaagcgaagctcgtggatgatgaaattgaaatcgtcgttcagctgaacggaaaggtgaaagcgaagctgaacgttccagccgacgcggacaaagaacagcttgaagagctggcgaaaaacaatgaaaaagtaaaagaacagctagaaggaaaaacgatcagaaaagtgatcgctgtgcctggaaagcttgtaaatattgttgcaaattaatggcgaaagccccttcaatccgaaggggctttttctgtcattccgccgaaaggatgataatatttcagacgatcgcttcgtttcaaatgatccatgaccgcttaaaatgggaaaaaaggagatgatcatgatgcatttttccgatttttccgccgtacaggtcagaatcgcccggcctacagaccgttttgacgaaatcgttgcattttacgaaaaggggctggggctgaaaaagcttggcggtttttccggccaccacgggtataatggcgtcatgttcggcctgccgaatgtccaataccaccttgaattcacctcacatatcgaaggaagcccttgtccggcaccgactaaagacaatctgctcgttttttatattcctgatccggaggaaatcaggagcatattaaataggctcgctgacatgggctatgacgaagtgccgcctgaaaatccgtattggaaggaaaaaggggcaacggtggaagatccggacggctggcggatcgtgctgatgaataccgaaggcatatagggatgttatgtctgttcccattctcttgccttcctgcggacgatatccgtaaaagccgccatagcaggagaaagccatttgtttttatgataaaccatttgagtggaaaacagggcgtcgcggaccagcgtgccctgaagctttccttcttcgatatcagtgcgcgttgtgatcaaaggaagaagggagacgcccaaaccgcacattacgcattgtttaatcgcttcgacactccaaaactccatcgtatggtcggcaatgactcccctttgacgtaaatattcctcaaaaaaatcacggtagctgcagccgtgctcggtatataaaaacgtttcatttgcgttaaaagtcaaatcatcaagagctttttgtcctgccgggtgttctttgggaaagatgaacaccatcggctcattgaccagcttttcaacatgaaggtcgttttctttccggtcgttgtccaaaagaaaagcgacatcgatttttccctgtttcaattcgtctctcagctgccagcacgtggaaggctttaaagtgaccgtgacctgcggatatttgcttgtaaattcgtgaagaatggcgggcagcctgtataccgttaaagattccgaggcgccgatgatcaagtttcccgacggctcctggtcgttttccggaatgtgcctcgctttttcatacagctcgaccatttctgcggcataagggagaaggtgctttcccgcttctgtcagcatcatttttttcccgagccggtagaacagcggctttcttaattcttgttcgattgcttgaacgtgcgaagtcacagtggactgtgcatatcctaaataatcggcagcacgggtaaaaccgccgatatccacgattgttttaaatgttttcaagtgtcggatctccatctcgtccatctcccttttttatcttatatcgaaaaattcgaagttgcagatcgataatatctattttactgatgaatcgaacatgattacaatcattttaaacgactttgtgaaaggattgtattcgtatgagagaaaaaaagcttggtcctttattgttaagcgggctgatgacggggcccattttaggatccggaatcattctgctgcctcctatgattcatcagacagctggagactacgcgatttttgcgtggctgttgatgctgggaatcggttttttatttgcctgggtttttgccagattaagcgtcgagtatccgaatgatgccgggattgcttatgcggctgaaaaagcgttcgggtcgcgtgttaaaaagttggcagtcttttattttatcatggctgcgagcttcggccccgccgccgtattaatgacggccggcgaatatattcattttcttgcggcaggcacggcattccctgctgaactgtacggctttgtttttttcatcttttgtatggttatcctttgctttaatctttcatttgtcggcatggttgcactcattttttccactgccgcggcgcttatcctgtttggaagcagcgcggcttccgtgccttacttccgtgaggggcctctcgtagacggaacatttcagtttaccgattttggccgcggattgctgctcctgttctgggcattggtcggatgggaaatcgtcggcaactacagcatggaagtgaaaaaccgcgggaaaacgattccacgggctgtcgtgatcagcagcctgacggtaacggtcatatatttggcgaccgcggcagctgttcagtggattgatcctggattctccgcaaacggacaattgaagctggcgatgatgctgacgccgttgttcggatcttttgcattgccggtgatcgcagtgctcaccgctgtcctctgtatgtgtgcttattttcaggtgacaggcggagcagccaggctggtggcctcgcaggccggcgggctgtttgcctacagatcaaggggaaatcagccgactgcagcgctggggcttatatttctcatccatacgatcgttttcgtctgcctgatgtttcactttcttaatgttgagacgctggttctgatcgcaaacgcctttttcatctgcaactcgctgtgcggtcttgccgcagcttacaagctgttatcaggccgcatttacaaaaaagtatgcctctttctcatggggggcttcacgctgcttcttttgttttcatcatcgtgggtattactgtttatcatgcttgccagcgcattgtttgttgtgaacttccgccaacttaacatctggaaaaaggtaaaacgccctttcaaatcgtattaatgaatcaaacgaaaaaagaaaggggaatacgatgcgcagtcaacttttcaaactgctcggcgatttgccggggaaaaaaagcattgatgcgagcactcttaaaatcgaagaaaagtcatcttttattctcgaaacgcttttgcttgatttaaacggaattgaagcggtgccggcctattttgcaaaaccgaaacagatgaacggcaagcggccggccgtgctttactgtcattcacacggagggcgctacgaaaggggaaaggaggagctggttgaaggagcggagtacttgcaagcgccgccgttcgccgaggaattgacggctttgggattctccgtgcttgcgattgatcattgggctttcggagacaggcggggcaaaacggagagtgagatatttaaagaaatgctttggacagggcgggtgatgtggggaatgatggttttcgacagcatcagagccatcgattatctgaaaatgagggaggacatagacgaaagccgcatcgcttcactcggcatgtcgatgggaggtctgatggcctggtggaccgctgcattggatgagcgggtcagcgtatgcgttgatatatgcgctcaggtggacagcgaaacattaatcaagacgcagaatttggaccgccacaatctctattcttatgttccagggctggtcaaacacttttcaaccgctcaaatcgaaagcttgatcgctccaaggcctcatttaagcctggtcggaaccgcagataaactgacgccggttcaagggattgacattattgaagaaaagctgtccgatgtgtatatagaaaaaggcgcaggtgaacgctatgaagtgtttcgttctcattcagggcacctcgagacagccggaatgaggcataaagcggtcggtttcttaaaaacatggctgtaaaacaggaggcgataaccgtgaaaaaggtgacgatcgtcggagggaacggcacggtcggccgcgtattagcgggcggattggcaggcgaagggtatgaggtgacagtgctggatttaaaagaaccggatgacaaacaggctgtccgttttatccgggtggatgcgacagattacaacgaagtcgtcaaaagcattcctgcacagacgaatgcgctgatcaatcttttggctgtaaagccgtcgggcgatttgcttgaccggcaggagtttgcgaaaatgacggatatcttttttaaagcgacatatacgattttgcgggcggcggcggagctcggcgtgccgaaagtggtatttgccagcagcaaccatgtgacagatgtatatgaaaagggcggcgattctctgttggggaggcagatcaacacaaatgactacccgcagtccaaaagcttgtacggcttgctaaaattggcgtccgaaaatctcggctaccttttctcgcaccaattagacgccaaggtttccgtcatcaatctgcggatcgggacagctgctgaaaatgagctagaaacgctgcacgcaaaaccgagaagcaaaaaaacgcttttatcccaccccgacctcatcggaatctttaaagccgctatcgaatccggcaaaacatatggtacatattatgctgtcagcgacaataaggggcggccgtggtcgatcgattccgccattcgggaactggggtacaggccgcaagtcagcgcctctgacatccttgatgaagactgacgtatcatcttctaaggtgatgatctttttctccgctttcctgctcctgcttaaaaaatgattatagacgctctcctttctgtctgctacattttagacacgatatcgtaatattttgacagcgcttacaaggagggggaataacgatcaggcattctgctggaagccgcgtgtttgacatattgaattattcatttttaacagggttcggattggtttgtgtgctgccgttcatccacgttattgcagcctcttttgcgacagtcgaggaggttatttcgaaaaagtttattttaataccgacgactttttcgctggatgcgtacaggtatattttttcaactgacattgtgtacaggagcttaatcgtttctattcttgtcacagccgtagggacggcggtcagcatgtttctttcctctttaatggcatacgggctgtcgagaaaggagctgatgggaaggcgcgtcctgatgttcttggtcgtgttcacgatgctgttcagcggagggatgatcccgacctttctcgtcgtaaaatcgctcggattgctcgatacctattggtctctgattcttccgaccgccatcaatgcgtttaacttgattattttaaagaacttttttcaaaacataccgtcaagcctcgaggaatccgccaaaatcgacggctgcaatgacatcggcatcttcttccgcatcattcttccgttgtctttgccggcgatcgcgacgatttcgctgttttacgccgtcacctattggaatacgtacatgcaggcgattctgtacttgagcgatgcgacaaaatggccgatacaagttttgcttcgccagattgtcatcgtatcaagcggtatgcaaggggatatgacggaaatgggagcagccgcggcgccgccggaacaaacgatcaaaatggcggtcattgtcgttgcaaccatacctgtgctgctcgtgtatccgtttattcaaaaacactttgcaaaaggcgctcttttagggtcaattaaaggataaaaacggaggggacaatatggggaaaaaatggctgatcccgatttttgcgttcgtgcttttggccggcggactgcttggctgttcgaacagcggagcagaccaggcttcttcgaaggaggagaaagtcgatttgaactcgcctttggacttgagctggatggtgatcctttaccatcagcagccgccgaaggacacggcgattaaaaaaatcgaggaactcaccaatactaagctcgatttaatgtgggtgcctgatgcggtaaaagaggaccgtttaaactcagcgctcgccgccggaaacctgccgaaagtcgtcaccattcaggacattaaaaattcatctgtcatgaatgcattcagatcggggatgttttgggaagtcggaccttatttaaaggattatccgaatttaagcaagatgaacaagctgatcaataaaaacgcttcaatcgacggaaagctttatggcatctacagggagcgcccgttatcaagacaggggatcgtcatccgtaaagactggcttgacaaccttggactcgatatgccgaagacagttgatgaactttacgaaacagcgaaggcatttacagaaaaagatcctgatcaaaacgggaaaaacgatacgatcggctttgccgacagaaacgatttgatctacggcgcctttaaaacattggggtcctatatgggcatgccgactgattgggaggaaaaagacggcaagttcacgcctgacttcatgacaaaagagtacatggatacgatgaaatatatgaaaaagctgtatgatgaagggctgatcaacaaagactttccggtgacgagcaaaacgcagcagcaagaaatgttttcacaagggaaggccggcatctatgtcggaaatatggttgatgccgtcaatctaagagaccagtctgtcgatgataaaatggaacttgagatcatcaatcggatcaaagggccggacggaaaggaacgcgtctgggcatcaggcgggcataacggaatctttgccttcccgaaaactagcgtcaaaacagaaaaagagctgaagaggattctggcctttttcgaccggatcgccgaagaggatgtttacagtctgatgacatacgggatcgaaggcgttcactataaaaaagaagggaataaacaattcaaacggatcgacgagaaactgaaagactggcaggcggaaattcagccgctcgtttctctcgtcggcattgataagcaatatttgaaaaatacgggcgatccgctccgcacaaaatatgaagagctgacagaggacaataacgaaatcatcgtctcaaacccggccgaaagcctgtactcaccggccgcatctgaaagaggcgatgaactgcaaaagatcattgatgatgccacataccaattcattctcggcaaaatcaatgaaagccagttcgagaaagcggttgaaaaatggcgcacgaacggcggaaatcaagtcatagaagaatatgaggagtcatttaaaaaagcagaaaaatagaagacaatcccggggagccgggattgtcagcgtgtcgacaaaccctcgcattcgttgtcaggcctgcgcgtcggtgctcacgaattccaacattcgctgcgctccgatgctcggccttcctagactgcaagggttttcattcacgctgaaaggatgacaaaatcccaaaactaaaagtcgttttgggattttgtcaacaatgtagacaatcccgaggagccgggattgtctttttatgccgaatggtttttcagctcgcggtatttgccgggtgtgattccttccagctttttaaatgaacggatgaaattctgcggatttttgtatttcagtttttcggaaatttcttttacggacatagtcgtttccgtcagccagtttttcgcgatatgatgcctgtatgatgacaagtattcgctgaacgatattttcatttccttcctgaagatgctgcttaaataattggggttgtaatgaagccttcctgcgatcgattcgagcgtcaagtccgtgtcgaattcctgctggataatatggacgattttttctgagatgtttttgtattgcgattcttctctgatgctgagtgtatcgatcattttaatgataatctgcgcgttcagccagctttcaatttcctcgatggtcgtcagctcaaagacgtcgtcgtacagcatcgtattttcgttcggttcaaaaatctcgattccgagcaaatgcataaattcaatcaagttgttcaacagccttgcaatcgcaatctggcagtgatgcggattcatgttttcagaacaaatcgactcaagaagaaggtgaagctgttcggccgcttgtttacggttgcacgttttaatggcttcaaacagttcattttgaatctgcttcggaaactgggttaaaaacgctttgttgcggtcaaggtgttcatagaaaatcaccgcgtgttttccggatttcagacggtatgtcagtgcttcaagcccttccaaataaccgcgctttgacattgcaagacttgtaaatggctggctgatgccgatgctgacgaacaacccaagctcttcatgaattttatccttaatggctgatgcggtatgctctaagtcttcctgaaacctttccagcggctgtccgcgattcagcatgatgatggtctgcgttttatcaatgacaaccggcggaaggcgcttattcttgggcacagatcgttcgacaaggctgttgatcgcaaacagcaggacatcaagatcctttttttcgtatgatgtgtctttcaatgtatcaatttgcagtgtgaataccgacagatggctccaatcttcagggaagccgagcccagtaaagcggtctttgatttcttcttcgctcagcttgccgagcaatagccttgttaaaaaatactgcttcagctgggtgacctgctgttcgacgcgcaccttcagatcatggtttttatttttcatttctttaatgttccgttcaatcagttcaaattcgtttttcggtttctcttggacggaatcggctcctggaggaaagccggagacggattcgtataaaaccttgatcggcctgtaaaaatggcgtgaaccaaaccaggagaataaatatgaaagcgctaacaaaatgaggcagatcgtaaacgtgaaccagccgattgatgccgtctgctgatagagttccggaatggtcgttaacgaaacgtatatccaattattataatctgatttctggtatgtaatgttataggcggtgtcgctgactgttgtatcaaactggccgtttttttcttggtgccggcggatcgttttgaagtaattttcttgtttgatcgattgcccgatcattgacgggtctgagtgaaggatgatccgtccgttgtcatcaagcaccatcatgctgtttgtttttgaatgatccggcatgcgcttgacaagcgaacaagaaggaatgctcgcgatcgcaaggcctctgttttccatgctgttcaggggaagctgtttgaccagattgacgttgtacaggcagtttcccgaagccccttcttttgtggcgacaaggccgttgtttttttcaagcacccagctggaacggctttttaaagcgttgtaaagcgagagcgtgatggcttgttttccctgatctaaagggtataaaccggagttgttgatataccactttttttcttggctgatcagcgtgatatccgacagatcggtatcgaatgtctggagttcgtttaattccttgttgatttggttatacagctgaaagcgttctggtgtaatggtgcggctgagcgtctgaattaaaggataggaacggacgtaattggtgaaggaatggtcaaccgtttttaaaatatgttcaatatttagctgtgtctggctaacggtttggagcttttcgtttgtaacgttttgttcaatcgtttccgctgatctctgataggaaaaaaagccgacgatgatgaccggaatggtgctcagaatgagaaagaaggtcaccagtttatagtaaaacttatattgttttctcttcataaattcccccccaacaaatcttcgtttgagttgttcatatataattaatccgacttttgtgtgaatttgtcaataatcattttctaaccatcgtttcattttattaggttttgccggctgccgggcgaggtgcggccgatgtgatgatatgattgtagatttattttttcatggtgggataaagtgaaagcaaacatcacgaagggaggccgtttatgaaagcagccgatgtccagaccggaaaaaatccggcccttgttgttggaaaaaaacgaaagacgcgtttttgggaaaagcttctccagcaaaaatatttatatttgatgattttgccgggactgatttattttttgctttttaagtatgtgccgatgtgggggattgtcatagcgtttcaggattaccagccgtttctcggcataacggggagcgaatgggtgggctttaagcattttgaaaggctgtttaccgaaccgacgttttttatgctgttgaagaatacattgattttgttttttctcaaccttgttgtattctttccgataccgattattttggcgcttttattgaatgaagtcagagtcgcattgttcaaaaagtttgtccagacgctgatctatattccgcattttatgtcatgggtcattgtggtatcgctttctttcgtcctgttgactgttgacggaggattgatcaatgagattatcgcctacttcggcggagaaaagatcaattttttgctgaatgaaagctggttcaggccgatgtacattcttcaggtcatctggagggaagccggctggtcgacgatcatctatttggcggcgattacagctgtcgatccgcagctttacgaagcggcgaaaatggacggggccaatcgcctgaggaggatgtggcatgtcacacttcccgcgatcagaagcgtcatcgtcgttttgctgatcttgaaaatcggcgatacgctcgaactcggctttgagcatgtgtatctgcttttgaatgcaacgaaccgcgaagtggccgaaatctttgatacgtatgtatacacggccgggttaaagcagggacagttcagctacagtacagccgtcggtttatttaaagcagctgtcggtctcattcttgtcgtatttgcaaacaggatggcgaagaaatttggagaagaagggatatattaatattttttgatgaaaggaattgaatgacatgaatcaatctctcatcacaaaatcgcctctttactttgctgaagaagcggccaaaacaataatgaaagcgtatacaccgaaagagctgccaccggccgggcgctggcactaccatcagggcgtatttctgtgcggcctgattcgcctttgggaagaaacggggaaagaagcatacttcaaatatgtaaaagaatatgccgatgatctcatcgatgactgcggcaatttttatttcaggagggatgagctggacgctatacaagccggacttctcctttatcctttgtacgaggagacgggcgatgaacgctaccgcaaagctgcaaaaaagctgaggggcctttttgaaacgctgaatcaaacagaagaaggcggtttttggcataaagataaatacccttaccaaatgtggcttgacgggttgtacatgggagggcctttcgcactcaagtatgcaagggcgttcaatgagcctgaactttacgataaggtcatcctcgaggaaaaactaatgagaaagcatacgaaagactgcaggacgggattatattatcacgcgtgggatgaaaagaggcagatgccttgggccgaccccgtctcaggctgttctccagaattttggggaaggtcaatcggctggtacgcgcttgcactgagcgacatgatcgaactgctcccgcaggggcatagcacaagacaggagtggacccggacgcttcaagagatggtcaaaagcattgctgattttcaagatgaaagcacagggctatggcaccaggttgtcgataaaggcggacttccggacaattggctcgaaagctcctgctcgtgtttgtatatgtacgcgatggccaaaggggctcgcatgggctatattgattcatcatatattgatagagcgacaaaggctttcaaaggactcgtcgaagaaaaaatcgagatgagcgcaaaagaaggcttgcttttaaaagatatctgcgtcggaacttctgcagggacatacgattattatgtcggacgggaaaaaagcaccaacgatcttcacggtgtcggcgccttggttatggctcttgtagaacttgaaaagaccggccgtttttcctgcggggaagcgaagtgaaaaacttcgctttctccgtccttctaatagcagcagtgcttcttcttacctcatgcggaaaggatggtagccggggaacagacgtattgattttttcggatgcaccggctgaagtaaaggaaaacgtgcagcgcgctgtcgggaaagaacagctcaacatcaccgttttcccggcaaccccggaaaaactccttgttgaaattgcggcgaaagaaggagatctgtttatcgttccagaagacatgtttaaacctttttacgatcctgaaggacttcagccattgaatgctgcttcggaagaaaaagagccgtacagcgctccgggcaaaaacggggaagtacagctgtatgcggctgtcatcgaaaaaggagaaaaacgtttgaacggctatacggttcagttgaatacagatatggcagctttcataccggtttatgcgaagaaaacccctgaagcgacggaactcatcgaagcgcttcaagcaaaatgaatgaaagggggaggagccgatgaaaaaatatgcgatatgcggtctgagcggccgcgcttttaacatgtttatcgagcctctggtgggaaaatacgggaaagaaaaccgcatcgctgcgctcttggacatcgatccgctgagggaggaagtctgcaaagaaaggtttccggcgcttcgccccgtcccgtttttcgaagagaaagcgtttaccgaaatgcttgacaaaatcaagccggacgccattattgtagcaggccgtgatgatacgcatgtccgctatatattgggcgctttacgggcagatattgacgtgatcactgaaaagccgatggtgacaacggcacgggatgcggcagccgtgttaaaagccgaagccgagagcaaaggaaaagtgaccgttacgtttaactatcgctacaatccgtaccaccgcaagatcaaagagctgatacttgacggaaagcttggcacgattacgtcggttgatttgaactggtacatcgatacgtatcacggcgcaagctattttaaacgctggaacaggatgagagcattctcaggcggtctttccgtccataagtcaacccatcatttcgatcttgtcaattggtggcttgatcaaacgcccagcgaggtttttgcctacggcggtctgtactactacggaccccgcggcgaaatgaatcctgaaaaaggggaaaaccgctattgcggaacatgccatgtcaagaagaaatgccgctattatatgaggtggcaggcaggcgacccgcaggacgaccatgtcaagaccaatgaaagccagcatctgctctataccgattacaggcctgacgcgtgtattttcgatgaagaaatcgacatcgaggatacgtatgcagccgttttgaaatacggcaaaggggcgctgctgaattactccgttcatttttcagccccgtatgaaggctaccggcttgcaatcaacgggacaaagggaaggcttgaaacacaggaatatcatgctccggcaagagtcccatttgaagttcccgaacagaccatcgattattatccgctgtttgaatcgaaagaaacgattcgcgtcgtcaggcagcccggcgggcatggcggaggagacccgctgcttttggaggagctgtttggcggaggagaccctttgaggaattacgacattctggccggtgccgaagcaggcgcctattcaattgcagccggcgaggcattgtggcgctccatcaaagaaaaaaagccgataggaatcagtgaacttctgcatacccggcaatatacataaagggggagagaaattcatggaacaaaacgtctccatgggaagggtgctgagcttttgtgaatgggtgctgaagtttttttacgccaatctgctgtggtttgtttttactatgctcggccttggcgtcttcgggtttatgccggcgacgactgcattgttttcagtgacgagaaaatggatcatgggcaaaaccgatattccgatattcaaaacgttctggcaggcgtaccgcggcgagttttttcgttccaacgccatcggtctcattctggcggcggccggcatcatcatttatgtagatcttgcttttatttatccggatcatctcctattgcacgttctccggttcgtcattatggtttttggatttttgtttttgatcatgctgttttatatgttcccgctgctcgcccatttcgattggaagaagcgaatgtatttcaagttttcgctgattctgggcatatcgtatttgcagtatacattaacgatgatggcggtcactgcaatgctttatatcgcttttgcgtttctgcccgggatcgttccttttttcagtgccagtctgcttagttatgcggttatgtggctggcatatcaagtgttgaaaaaagcggaagccgcagaacagaaggaaaccgtcataacgacaagacacacttaatcctttgttttaggtgtgtgaaaggagctggcccatatgggtgaagaatttgaaaaacgatatcttcactggattgatgaagccgtgaaggagagcgaaaagaaagacgatttcaagtccctccccggttatggaaaaccgctcagcaaagagatgctcgagggggatgcgctttcgtcaacccttaaaaacgcccgatatctgccggaatggctgaagctgcaaaaggaaattaaacaagagattgaaaaagcgatcaaatcgaatcagcgcgaaacgctgattgatgccatcaaccaaaaaattaaaaaatacaacctcacctgtccgaaccaattccaaaaaggccttgtttcagccaaaaacctcgaaagtcagctcaaatattggagctgatgccattccctgcacttattcataaaaataattgccaataacaatcatattatgtaaaataaaggtaatatttatgcttttaaaaaggagaaaggatgaatgaagaagtggaagcgaaagcggcatacgaaaaagcggccgggctcctgaatcagtggtacccatgatcaagcgccatgaagcgctccaggctgtatctttgaggtacgagatccaaaacctgctttctaaaatggagaaaagcggagatctggagctttattttcagctgttggactatcgctgcaaattgatgatggagcagtttgcagaatcagccgagcttttccggaaaattaaaaggcagaaggaaacggttaagagcgcggatgacatcattcagtactattttttctttttttcaggcatgtatgagttttatgagaaaaactatcttgaggcgatcagctgttacaagaaagcggaagcgaagctgcataaactgaccgatgaaattgaaaaagcggaattttattataaaatcgcgaccgcctactaccaaatagacgatcatttcagatcgttgaactactccgaaaaagcgctctcacttttcagcaagcataaagaatacatagacaaaacgatcggatgcgaaatgatactcggatcggtgcagtttgaattgttccgcatcaaacaagctgaggagcactacgggcgggcgcttgatcaggccgttgcccttcaaaaccggcgaatcatcgggctgatctatcataatatgggactgaactatgccaaatgcggcatgccgcttttggcggaggagcactttagaaaagccctttcaatcggtgtccatgagcaatcggtttttggcattaacacccttttcgagctgtctcacctcatgtacaaaaacggttctcccgaagaagcgagacgtctctgcaaagagggatttaccagatcggccgaattaggagaggatgaatacgcagcgaagttcaggctgattttcgccctgtatgacgctggccatccgctcgatattgaattttcgcttgaatatatgagtgataaacggctatggccgcatgttgctgaactgacaaaagatattgccgactattacatgaagtcaggcgaccatgaaaaaagcgcgctttacctggaaaaatcgcagcatgcgaaaaatcaaatatataaaatgaaggaggggattatatgaaaaaaaacatttgttttttcgccgtcatgcttgtttgcctgatggggggaagcttcacagctgattctgcagcacaggacggatcgtttcagccattgggaaagtcggtgtttcctgacagcggacgatagagaaaacatgccgaaatagaaatggcctcccgacttttgctataatagtctcacctaaaggcaattgaagggagcagtaatgatgacgataaaagagatttcgcctgatgaactgaaagacaggcttgcaaaaggagaaacgctgaacattatcgacgtcagagaagatgaagaggtggctgaaggaatgatccctgaagccgtccacattaaaatgggggatatccctgaaaaactcgacgtctttcaaaaggatcagccttatatttttgtgtgccgatcaggcaaacgaagcgaaaatgtctgcctctatttgcaggataaaggctttgatgtcaccaacatggtcggcggcatgctcgaatggaccggaaacacgaagccgaaaacaaaataagcggatttgacttcttatctgtacaggtaagaagtttttttatttaaaatggagcaccaaatgccaggtaacgttcggagcgtctgctgccaatgttgaaggctcttttgctaaggattttaagcataacttcggctgtgtgcgaatacctttcattatagaaaggagagagcgtatgctgaaggtggccgtatttgatgaagaacacgaaaaagatttgcagcatgaaatcaatgaattcttaaaaaagctgtcggaagaccagctggtcgatataaaatatgacgtatcagccgcatgcgatcctcaaggcgaacagctttactgtttttcagcgttaatcttatacaggacataaaaaaacagctcttcagagagaagagctgttttcatttatgcttttttcaccctcgggcttcttggcttctggaatttctcggcttgtttaatctcttttcgttcttgtgacagagatttatataacgatacaatcatgagaatcacgacgactgagaacggcagtgcggccaggatggcggtgttttgcagcgccgatagtccgcctgaatacaggagcgccccagccattgctgactggatgatgccccatgatatcttgaccgaattctcaggattcagtgaaccgtaagtcgtttgcattccgagaacaaatgttgccgagtctgcagaagtgataaagaatacggcaatgagcaacaaggcaacgatagatgtaatcatagccagcgggtagtggtcaaacattccaaacagcatcgtgtctgtagacagttttgcaacgttgaaaatccctttttgctgaagatccatcgctgaaaccccgaaaattgaaaaccatagaaacgccagcacagtaggcgcaaacaagacggcaatcaaaaattccctgattgtgcgcccccttgatacgcgggcgatgaaaataccgacaaacggcgaccaggagatccaccaagcccagtagaaaatcgtccatgaattgatccattcacggctgtccggatcattaggcgcaaggcggaagctcatttgcaccacattggagatatacgttccgatcgtgtccgtaaacgagttcataattaacaccgtcggtccgacaaacagcataaagatcatcaggacgccggccagcaccatgttcgtattgctcaaatacttgatgccttttccgattccgctccaagcggaaattaaaaacagaacggtgatgactgcaatgatcgccagctgcacctggaagctgttcggcactccgaatagataatggagtccgccgttgatctgcgtggcgccgattccgagactagtcgctacaccgacgacggttgcaaatacagcgatgcagtcaatcccttttccaagcggtccgttgactctgtcgccgaagaccggaaacagcgtcgcgctgatcaagccaggcgcgtcttttctgaattgaaagtatgcgatgcaaagggcaacgatcgcatagatcgcccaagcatgcaatccccagtggaaaaatgtatacctcagagaatctctgaaggcctgggctgtttctgtttcacctgatggagagctaatggcataatggctgatcggttcagccgcgccataaaatacgagaccaatgcccatacctgcgctaaaaagcatggcaaaccaagataatcgagagaattcaggtttttcttcaggtttccctaatctgatctttccaatcggactgaagatcaaaaagatgctgaatgcgacaaacagagaaaccaccaataagtaataccatccgagtgtgtttgtaacataaccttgaatcgaagtcgttaacgcctgaaggttatccggagcaacgattccccataatacagctgctgctgtgataacaatcacaatccaaaaaacgcttgaaatatttttcaaaatcatcctcaccctctaatcatttttcgtccttactcccatcattatgtttagtatgagttgcacatataaaaatcattctctctcaggaagtttgacctagcttcccctattaccccacaatcaggtgaaacaaaactctttaaccgtaacatacttttcaaaaaaggcacaagtctcagcactgggctgaaactctgccattccacatttgtcaagggtttggagcaattttatttttttctccggcaaagcgaaaattcgcctgcattcaagcctgcaagtctgcctgtgacaagcgcggatgtgatattatacccacccgtatagccgtgaatatcgaggatttccccgcagaaataaagcccttccttttttttggacgccatttttttaggatcgatttcttttacggaaacccctccgccggtcacaaaggctttgtcaagcgaaagggtgccgttcacgttgacagtaaactctttacagtctttgacgaaagctctgaaacggtctttggaaagggaagagaaggtttcagaaggatcaatcttgttgcgctcgaaaagaaacagcagatacctttcctgcatccaaggcttcagcacgtttttgagtgatttcttcggagcgtccttcaattctttatgcatgcgttgaaaaagctgttcctcatgaatatcagggaacaagtcgattttcagcctgactttttcctgctttttcaactctttgacgacaaattggctgcatctgaggactgcgggtccggacagtccaaaatgggtaaaaatcatatccatttggtgggtgatgaccggctttccttttttgttcaatacgctgagggcgacgtttctcagtgataggccctgcaatgttttctgattgataaatggctcgtcagacgtaaccggaacctctgtaggaaacagttccgtaatcgtatggccggctttttccgcccattcatagccgtctccggtcgatcccgtatgggggacgcttttcccgccgacagcaataacgacagatcccgctgcaatttcttcaccgctgcccgtcacgatcccgaacgctttttcttcattgtataggacagttttcactttttcgtttgtacgtacgcttacatgaagctgttcgagccttgttaaaagtgcatccactacgctttgcgccttgtcggagacaggaaacattcttccgtgatcttcctctttcagcttgacgcccagacgctcaaaaaacttgatgatgtcctcattgttaaattcagaaaaagcgctgtacaaaaagcgtccgtttccgggaatatgccggatgatctcatcaaccggcaagcggttcgtcacattgcaccgtccgcctccagaaatggccagcttgcgtccgagtttgtttcctttgtcgattaagagaacgtccgccccctgttcaccggccgcgattgcggccatcaatcctgaggggcctccgccgatgacgatgacatcaaaatacttcataccaatatcctcaactttcctgtcttgtaaagcctgcattctgtgcaggcggggcagattgcatcagacaacaaccgcgctccatcttcttattataacgaaagaacggcatgatgaaaaaacgataaaacaaagccatgttaaaatttagccatgttattattaactgagtggagcgcctgtatgttaaaatagaaaagttgaatctattgaagaaaaatggtgattgggaacatgtcaagcaaactgttaagaggcacatttgtattaacgcttggtacctatatttcaaggatcctcggaatgatttatttgattccgttcggagccatggtcggtgccaccggcggtgccctgttccagtacggttataatcaatatacgatttttttaagcattgcgaccatggggtttccggcggccgtgtccaagtttgtttcgaaatataactcgatgggtgattatgaaacaacgagaaggatgctgcgcgccggaatgtcgatgatgctcgtcacaggcatcattgctttctccattctatatttgtccgccccgttttttgcagagatggcccttggcggaacagaaaacaacgggctgacgcttgaacatgtcgtgtatgtcattcgcatggtcagtctcgcgctactggttgtgccgatcttggcgctgatcagaggatttttccaaggtcaccagatgatggggccgacagccgtttcacaggtagttgaacaaattgccagaatcgtctttctattaacggccacttacttggtgatcaaagtattaaacggcgggcttgtcgtcgctgtcggctatgcgacttttgcggctttgatcggagcgttcgccggactgttcactctttacttttcctggcagaaaagaaaaggggcgctcctggcgctgaagccgaaccttgttccttcagccgatattacgtaccggcaaatgtttaaagagctgttcagctatgccgccccttatgtctttgtcgggctggcgataccgctttaccagtacattgatacgaatacgtttaataaagcgatgattgcagccggctatcaaaacatcagccaggatttgatggcgatcgtgacgctgtacgtgccaaagcttgtgatgattccggtatctctcgcgacggcattcgggctgacattgattccggcggtgactgaaaactttaccaacaaagatttccctgctttaaacaaacagattgatcaggcgatgcagatcattctcttcatcgttcttccggcatcagtcggtatggctcttttgtcggggccggtttacacgtttttttacggctcggaaagcctgctccctgaaatgggacgagatattttgttctggtacgcgcctgtggcgctgttattctcgctcttcaccgtcaacgctgcaattttgcagggggtgaacaagcagaaatttgcggttgtcagcttgatgatcgggattgtgatcaaaatcgcgcttaacgttccgctcatcaagctgcttcaaggcagcgggtcgattttggcaacggcgctcggctattcagcttcactcctatacggatttatcatgattaaacgccatgccggctattcgtatcgcaaactgtttaaacggtttttgctgatgctgatcctgacggcggtcatgggcatcattttgctgcttgtccaggcgcttctaagtatttttatttcatacgaaggcgggcagatcaggtctgctgtcgtcattttcatcacaaccgcagtgggcgggtcagtttatctgtacttggcttaccgtgtgaaactgctcgaaaaaatcttcggtcagcgattgaatcgctttttcaaaagaaaggcctcctaaaaagggcttttctttttatgtaaaaaaaggggtgtcttcatgagattggataaactgttgtcaaacagcggctatggttcgagaaaagaagtcaaaaaaatgctgaaaaacggcgcggtgcgcgtcaatgatcaattagtcaaagacgccaaaaagcacgttgacccggaatcagacgacatcacggtatacggggcacccgtcatgtaccgggaatttatttacttaatgatgaacaagccgcaaggagtgctgtcagcaacagaagacagccggcaggaaacggttgtcgatttgctcgacccggagctgctgaggtttgagccgtttcctgtcggaaggcttgacaaggatactgagggactgctgcttctgacgaatgacggacagttggcacaccagcttttatctccgaaaaaacacgtacctaaaacgtatgaagtccatgtcaataagccgattgatcaagcggcacttgatcagcttgaaaaaggggtcgatatcggtgaaggatatgtcacgaaacctgctgaagcatcgcttctggcaagcgaaaacggcgtagaacgcctgcttttgacaataacggaaggaaaatttcatcaggtgaaaagaatgctgaaggcggtcggccatgacgtcatctatttaaagcggctgaaaatgggggatgtcgatctcgatgaagagctattgccaggggaatacagggagctctctgaacacgagcttgccgcattgcaaaacaaaaagacactctgattcatcgagtgcctgaaatgggtttgtggagcatcgaacttaaccaagtttgatgctttttatgtttgatggctttcttatatgatattcagcgctaaagttcaatttttcagaatactgctatgaggagattttcactttttttcttgtagtctcccatttgcctctgctggggctgtgtactagatcgttgtatgccaacacattcagatcacgctggattgttctcggtgtagtgccaaattcatcaaccagttcctgggttgtaacgagtcccttttcttgaatgaacatgtagactgatttgatcctggttagcattcggtttgttgaaggtttcaaacaaccactccctatcgtatgatcgaatggacttgactaccacaacttacgactccaaaatgcagcatggacggttagcgaccatttcttgaaaatgatcaataaatattatacacgatccctttgccaaatatccagaaaaaaggcggagccaaattattgaaaaaacgaaaatcgcgagcagaacatgcagtgcgaacacgtttttttgatgaaaaaatttaaactttttctttcttcatacgtaataaaagaaaggtggtgaagatgatgaagttaaaagtacatattgaaaaaaccccgtctttttaaataagacggggttcagttgattaatgcccttccaaaaagaaaaggtgtatgaaaaagagaacagcaaacacgaagacaagcggatgaatctcgcgccatttgcctttcgcggctttcacaatcggataagcgataaacccgagggaaatgcctgtcgcaatagatgatgtcagcggcattgtcaagatgacgagaaaggccggaaatgcttcgtcaagttctttccagcggatgttcgtcacggcgccgatcatcatgcttcctacaatgatcaatgccggcgacgtaatcgctgcgattccggagaccgcactgacaagcgggctgaaaaacagggccgcgccgaaaagcacagcgactgttaaagacgtaagccccgttcttccgcctgcggccaccccggcggatgattcgatataggcggtcgtcggacttgtcccgaacattgcaccgactgtcgtcgctgtagaatcggcaaggagggcttttcttgcattcggcagtttgttgtttttcatgagtccggcttgctcagcgacaccgatcatcgttcctgtcgtatcaaaaatcgtcacgagcagaaacgaaaagacaaccgaataaaggccgtagtggatgacatcgccaaaagcggcgaaagggtttgtgacgatcagtttttccggcagatgaggcatcgacataatccctttggtaaactcaagctggccggtaaaaaaggcgatcagcccggttaagatcataccgaaaaatagagcgccgctcacattcatcaccatcaaaacgacagagaaagccaagccgattaatgccagtatcactccgggcgagtgcagattgccgagtccgaccaaattggcttcgttcgcggtaatgatgccggctcctctcagaccgacaaaagcgataaacaatccgattccggcggtaattccgtattttaaattagccggaatcgcttcgatcagttgttttctaagaggtgttagcgataagataataaagagaatgccggccgcgaagactgtgctgaacgccgtctgataagaaatttcgccgttggatgagccgacgactgacactgcaaaatacacgttcagtcccatcccgggtgcaatcgcgatcggaaagttggcggcaagcgccatccaaagcgttccgacgactgcagcgatgattgtggcagtgaacacttgatcaaacgggacgcctgtgccggaaaggatactcgggttgaccacgacgatataaaccattgtaaagaaggttgtaataccggcgaggatttcttttttgactgtggtttggttttcttttatgttaaacatcatttcctccaataacgaacattatagcaaaacaatatctatattattcgttatcgggtgtttttgcaagggtttttggctaaactgaaaaaagaaggggcgaaattatgaactgggaacaggaagttttaaaaagacggaatgagatcgttgaggatattcagggttttttaaaaatcaacagcgtccttgacgaagagacggcgggtccgggacggccgtttggaaaagggattcaagaatgcctgacagcgcttctgaataaaggggaggaaagcgggtttacggtaaaaaaccttgacggttatgcaggccatatcgaatgggggaaaggcgaggagattatcggcgtgctttgccacattgatgtcgttcctcccggcgatggatggacgagcgacccgtttgcagctgaaataaggggcggccgaatctatgcaagaggagcgcttgatgataaagggccgacaatggccgcgtttcatgcattaaaaattgtcaaagactcgggcctccctttatcaaaacggatcagaatgattattggaaccgatgaagaaagcgactggcgctgtgtggagcattactttaaacacgaagaaatgccttcggccggttttgcgcctgatgctgattttccgattatctatgcagaaaaaggcctgattgacgcagctttaaaaattgaaactgatcaggcggaaacaggtgcggacttagtattggaggcattccggtccggccggcgcctgaacatggtgcctgatgatgcggaagccgtcctggcaggggccgtcccgtcagaatttgaagagtcatttgcccggtttgtaaaagaaaaacgcgcagaagggcgtattcttcaagaaggcggcagactgacattaaccgtgcacggcaaatcggctcatgccatggaacctaataacggagtcaatgccggtctcattttggccgagtttttacatacacaatcccttgacagagccgggctccattttgttcaaacggttagcggggcttttgccggaaatacgagagggaaaaagatcggcatcggctgccgcgatgacatcagcggagagctgacgctgaatgtcggccggctgcagtatgaacaaggaaaaggcggggaggcccatattaacatccgctatcctgttactgaagagagcggccgggtgaaatccgggctttcacaaataaagggcgcccggctcatcagctttaaagacagcaagccacatcatgtagcaaaagaccatgaactgatcaaaacgctgcagcgggtctatgaagagcagacaggggaaacggcacaattaatttccatcggcggggcgacatatgcacgatcactgaaagccggcgtggcattcggcccgctgtttccaggccgtcctgacgttgcccatcagaaagacgagtatatggaaatcgacgatttgctgaaggctgtatcgatttatgcacaggccatttatgaattggcgaagtagcaaagagagtgatggcatgagtcataagcgaggcgttttatttgaaatcccgaacgggtacgggcgctttcttctcgatatactgaagccggttgaaccggccgatttcaattggctgcttgccgatggcgaatgctatctcgtggaacggtgaattgtcagatgaaaatctttttcctcaagatccgcaggtgatgacaggagaagcatttaaaaaaaggctggaagacgcaaggtgctatctcatcttcgccgatctgaaggcttttccgaaggatggccatcccgaagatgtcagcacatatgaatcatatatgaaaagcagctgcgagctgattgtgcttacagccgattcgagttttgtcacgatatactgcaaagatcaaaaaaacctggagcttctatatcaaaatgcaaaggactgcggtttcaagcggattgaatatataacggatcacaacgatgccagaacaggaatgcatgtgtagcacaacatagacggccgctctagagagcggcttttttgctgttaaacattgctgttttcagggataacgaatatagtgaaggtgcgtacaggcgtccgggaggagagcggctttttgaagcaggaaaaggaattgaaacggttttattcattttatttttgttctttttcggttgcggggcgttttatccgcttctttccgtgtcggcaaaccatcgcattcgttgccaggcctgctaagtcgatgctcacgaacaaaagagaaacggcggctaacggagcgggcgtcgtcctgcctgaacactgccgtcatcacatcctgtgaaaaccagctccaatgctcggccttcctagactgcaagggttgcgttcacgctgaaaggatgaaaaaatcccaaaacgtctcttagctttgggattttttcaacaatctgagcctgatttcaaaacagaaatccaggcttttctctcttaatcaaattgaaataaatcgcttgataaatagcgttcccctgtatcggccgtcatgcagacgaccactttgtcgggagggagcttcttggccgtttcaacagcagcgaagcaagcggctcctgaagaagggccgacaaggattccttcttcccgcgccaatctgcgcgtcatctcataggcttcttcatccttgatctttaagatttcgtcatagacgttttcgtttaaaatgtttgggataaatcccgggcttgtcccgacaagcttgtgttttccgggtttgccgccggataaaacaggcgaccctgcaggttctgccacgtgaacggttattcccggaaataaagctttcagcttttcgcctgttccggtaatcgttccccctgtccctgctgttgcaacaaatgcagcgagaggtttgccgatttcttctattgcccgggcaatttccagagcggttgatctccggtgagcctccggattggcttcattatcaaactgcatcggaataaagctgcctgggatttgccgagcgagctcctgcgcttttttgatgctgcccggcattctttcatcccccggcgtcaggacgacttcggctccgtacgctttcagaagattgatacgctcctttgtcatcgtatcaggcatgacaagaatggctttgtagcctcttgccgccgcgttcatcgcaaggccgatgccggtgttcccgctcgtcggttcgatgatggttgaacccggtttcagcaggcctttttcttcggcatccaggatcatttgataggccgcgcggtcttttacgcttccgctcggattaaaagattcaagcttgatataaatttgggccgcgttttcgggctgaacgcggttcaacttgacaaggggcgtttccccgattaattctgcaatattttgaacggctctcacaactgtgcaccctttctgaaaaacatgattctgtcaatatcctatcataaggccttggaaagtggaaaatagagaggttataagtccatattttttgttaaaatatagagaagacgaatgaggaggaagccatacatatgtcagtcaaaccgcattactttattggaattccaattccggcggagcttagtgagccgctttatcaaacggtcagcagccgtccggaattttcttttcatagatgggtgcatcctttggactaccacatcaccctcgtgttcctcggctctgctgaaaaggagcagctggcgatgcttgctggcagcctcaagctgatctctgatgagacggctccgtttcagcttgcgataaaacgtttcggaaccttcggaaagccgtcggagccgagaattcttcatgtggaaccggaatactcagccgctctcttccatgtgagggaacaggtgaagcatgcagcggatgaggcgggctttgaaattgaaaaacggccttttcatccacatgtgacggtcgccagaaagtggaatggatcggcctcttttaacggacgcctggagccgcttgaagacgcggtgtcttttacggccctgcatttcaccatctttcaaacccatttagacaggcttcccaaatatgagcatcaagccgttttccatttcggcgaacggccggctgcagaaaagcaagattcggagatgaacgcagatggcacagattattaaaatacaggactgtatttcaaggtatgaacaggatccttatcattatatcaaccagtttatccgcttgaaaaagcagcgctggcagtcaattaaagagatgtctgaaaaaaagaaagaaagctttcatcacgataaaggagccgccggtgatgaaacgttcggaaaaagaaagaatacatttacattaaagagaaaaaaagaagcatccgatattaataaaggaaaagaagccgatgaatggtttaacggactggacggagaaacggatgaaagcttgatcgcaagaattcctgcggcaggggaagaactcgtaccgttttttaaggaatacgtgtacgagtttcagctgaaatgggcaagctcgacaatctctgacatatccaggctttcccgggaaataaaaagcgataaaatcctgcacattttggcacagcagctcccggattcatatttcatcatgtatcggccggtgctgcaggtgaatcaggctgcggtagagctcagcgtcttgattctcactccccttgaaatctactgtatgtcatttcttgaaggtgagagggacagcgcatttatcggttccaaagatcgtttttggaaagaaaaaacggtaaggggcaaggaacggtcattgttaaatccggctgtcgagctcctcaggacaggcaaggttctttccggtttgttaaagggatcgggagttgaactgcctgtgcgcaaagtcatcgtcagccgtacatcgtacatcgattatccggaaccaccatacggaatcggcatttgcgacaagagacactggaaagagtggctggagaaacagcaaaaaaacttcgccccgattaaaagccagcagctgaaaacggcgaaaattcttttgtcgcacggcgtctccgactcggtgcggaggcaggaatggctgagctgaccgacagaacgttatcccggctttttcatactataaaatggagaatggaatcatgagcgattggtatatcatcataaatccaaaggcgggaaactcgacggccttcagagcatggaaatcattgcagaaagacctccaaaaggcaaatatatcgtaccgctcgtttatgactcagcatcccgggcatgctgaggtgttggcaaggcaaatatcaacgatgcaggatgacaggctgaagcgtcttctggtgatcggcggggatggaaccgtccatgaagtgctcaatggtttagtcagcttgcgggacattcagctgagcgtcatcccgtcaggcataagcaatgattttaaacgcggctttggcgtgaaaaaatcgaatgtcatcaaagaaatgaagcgaaaagggcaatcgctgacccggacctatgcccttggaagctttcatacgaaagacagtgataatgaactttattttgcgaatcatctcagcctcggatttgatgcatgcaccgccaagaagatgtcagctttgccgaaatggacggctgctctcaggctgaatcatttgattcatccgctgattttctttgtcacggcgtttacgtctaaaccgtttgttctttcgtatgaaaacggggatgacaagcgtacgtttaaaaaaatctggtttgcgtcggtttcaaaccatccttactatggcggaggaatgaagattgcaccgaatgcgaatccgcgggatgagcttttagacgtgatcattattgaagacctgcccgtcttgaaaaaagccggcctcttgtttgcgatgatattcggcaaacacgtcggcaaaaacggtgttacggcatttaagacgaaagacatctattttcatacgaatgagcgggtgctctttcaagcggatggagaggtgatcggctgggcgcccgttttcattaaaacagggactgaatcccttcgattaagagcataaatctttcgaatgaaggagagactgaaatgccgggtatcagccgcccttttgaagcttatctcgatgaaatgagaacgatcactgttttagttccgaagagccgtgcgtcaagctgcagccctccttttctgcttgaagatgatcaaggagagaggatagagctttcggtaaaagcgcaggtggagcttgaggaacaattcaagtatgttcttgaaagcagctgcaatgttccattcggaagagttcacaaagtatgctgtgaagaaagcgtctggacagacctgcaaatcggctctgttacgagaagcgcggcgtttgacaaggcttttttttatgacggccgcctcggcgctttttattcaaaaggaagtactttatttagggtatgggcgccgaccgcgagtgcggcaacgatcaagctggagaaccctgattcgcttcaaacaaatacttttcaaatgatgcgcagaaaaaagggcgtttttgaggtaacggttgaaggcgatctaaacggctggtcctatttatatgagctttatgtaaatgggaagccgttattgacagtcgatccttatgcaaaagccgttacggcaaacggggaaaaaggcgttgtattagatccagaggaagtcaaggtggaaaaacaccgcgctccaagacttcacagtccgtgcgatgcggttatatatgaggttcacatccgcgatttctcgattcatgaagacagcggtatgcgccataaaggcaaatatgttgcttttacagaggacggaactgaaacatccggcggcttctcaacgggaatcgcctatttgaaagagctcggcgtcacccacatcgaggttctgccctttcacgattttgccggagtggatgagctgtctcctgatcaatcttataattggggctataaccccctccattttaatgccccggaaggaagctattcgctcgatccgcagaaccccaaatgcagaatcaccgagctgaaaacgatgattcagtcgctgcacaaacacggcttctccgtgattatggacgccgtatataatcatgtgtacaagagggaaacgtccccttttgaaaaaacggttcccgggtattttttcagacataatgtatacggttttccatccgacggaacaggcgtcggaaatgacattgcttctgagcggctgatggtgcgaaaatatattctcgattctgtccgctattggctggaagaatatgatgtcgacggcatccgttttgatttaatgggcattcttgatattgaaaccatccgccaaatcagtacgcttgccgagaatataaagccgggcgtgcttctgttcggagagggctgggatttaaataccccgcttgacagcgggcaaaaagcaacattgcaaaatgccggaaaagttccggcggtcggcttttttaatgatcggttcaggaacgcagtcaaagggagtacattcgagcttagcgaccgcggatatgctttaggggacaccggaaaaaaagcggcgcttcagcacggtattgccggttcacccggattcttgcagccggcacagtcaatcaattatgtggaatgccatgacaatcatacattttgggataaaatggccttatgttttgaagaagatgcggacactaaacggcttaggcaaaggctcgcggtgtcgatcgtcctgctttcgcaaggcgttccatttcttcacgccggtcaggaattttgccgaacaaagaatggggacagcaacagctacaggtccggagatgacatcaataagcttgattgggaaaagcgtgcggagctttgcgaggatgtcgaatatgtgcgccagctgatccggctgcgaagaagccatcccgcttttcgtctgcaaaaagaggaagaagtcaaggagcatctttcttttatggacggtacaggagaggtaacggcctacaagctgaagaacattgcagcaattgatccctggaacgaaatcatagtggtgcattgtccgtttgcaaaaaaggagacgcttaagctgcccgatcagaaacagtacttgctgcactgcgatccttttacgttcttcaatgggaaggttcaagcggaaaaaaggcttcggctgaacggcatcgggacctatgttttatacgaaccaaaagggattttttagttttgcttgacgaagtttggcgtctagcgctaaaatttaaaagacggctattgtttagcacaaatgactctcaatagccgtctttttatttgaatataaagagacgacaatacaagcagtttgctgcccgctctagggggcagatgctttttaaaatcttttaatgaaatgatgggttgaaaatcgatatgaactggttgggacaattactaggtagcgaatgggagatttcccccgcaggaggagctacaggagacgcatattatgcagaacataatggacagcagctttttttaaagcgcaacagctctccttttttggctgtcctgtccgcggaaggaattgttcctaagctcgtttggacaaaacgaatggaaaacggggatgtgattacggcacagcactggctcaagggaagagagctgaagccgaaggatatgaacagccaggcggtggctgagatgcttcggaaaattcacagctccaaagagcttttggatatgctgaagagactcggcaaacagccttttcagccaagctctgtaatcactcaattgaagcagtttatccaggcccggcaatatccgataccgcagctggaccaggcccttttgtatctggagcaccatcttgaagatgtacagtccggagaaaaggtcgtctgtcactgcgatgtcaatcataataattggcttcttacagatcagaaccagctttatttaatcgattgggatggagcgatgattgcagaccccgcgatcgatctggggccgcttctttatcattacgttgaagagcgggaatggggaagctggctcgaacgctacggctcttctcttacagacaatctcaggctgagaatggcctggtacgtattggcggaaaaagcaatgacgacactctggcaaaaagcgaaaggcaatcaggaaggctttcaccaggggctggaacagctgcatgaattaatggagcgtctcgccaggtcctcatgaaaatgagtcgatatcttccacccattgcgtgagataatcctggtgctcctgaatgtggttgttgatcgaagcggaagatcttcccttctggctgtacaaataaatgtcttccaaaacgcctttcaagccggcgtcaagattcgtgtttgccattaaagacttgataatccgctccatctgttcgcattcagcgacggttccggtgcagtctgcttgatggtctgagagaatgtcttttaatagatgaatctgattttgctgatttaagcccataatattggcacttcccttcattctcggagtatatggattaaaatgttcagaaagctgtaatttatacgcgaaagacccggaggccgatcttcggtcttttttgctttggaagaggccttgcgggattcctgcgtttcatggtatgttgtaagacgatataacagatagaggtgtaagtacatgcgaatgcgtcacaagccatgggcggatgactacctggctgaaaactctcatattgtgatcagcgagccgtctcaatacaaagggaaatggcattccgtttttggaaatgacaacccgatccacatcgaagtaggaaccggaaaagggcaatttatttcaggaatggccctgcaaaacccggatgtaaactatatcggaatcgaactatttaaaagcgtcatcgtaaccgctgttgataaagtaaagcagacagaggcgccgaatgtaaagctcttgaacatcaatgccaatatgctttcagacgtttttgcagacggggaagtcgaccgggtctatttgaatttttccgacccgtggccgaaaaagcgccacgaaaagcgccgtctgaccaatcatgcgttcttgaaaaagtatgagcaggtgctcggaggcaagggagcgattcattttaaaaccgataaccgcgggttgtttgagtactccctcaccagtttttccgaatacggactcgttttgacattcgtcagccttgacctgcatcaaagcgattttgaaggaaatgtgatgaccgaatacgaagaaaagttcgccgctaaaggccagccgatctacagagtcgaagctgaatggcgaacataaaaaaacagactgcttcctgcagtctgtttttttgctttcaaatgaagctgattcaggttgcattttttgctacgataggaagaggagggatgatcatggaaactttaacaatcggacgaatcaagctgacatggctgaacggaggcgtcacgcacatggacggaggcgccatgttcggcgttgttcccaagccgctttggtcaaaaaagtattacgccaatgagaaaaatcaaatcgaacttagaacagatcctatactagttcagaaagacggcacgaacctgctgatcgattccggtatcgggctcggcaaactgacggataagcaaaaacgaaattacggagtcaccgaagaatcgtcaattgatgactcgttaaaagcactcgggctctcaacggaagatatcaaagccgttttgatgactcatctccattttgaccatgcatgcggattgacgcgctatgagggagaaagccttgtttccgtgtttccaaatgcggcgatttacacgtctgcaatcgaatgggaagagatgagaaacccgaatatccgctccaaaaatacatattggaaagagaactgggaagcggttcagcatcaagtgagaaccttcgacgagaagcttgaagttttgcccggaatcacgatgcatcatacaggcggccacagcgacggccattccgtgatcgttctcgaagatgccggtgaaacggcccttcatatggctgacattatgccgacgcacgcccatcaaaatcctctctgggtgctggcgtacgacgattatccgatgacatcgattgccgcgaagcaagcatggcaggcgaaggccgccgagaaaaacgcctggtacattttttaccacgatgccctttacagagcattaaaatgggatgaaaacggcgatattgcagagtcagtaaaaagagaaagccgctagctattttggtgaatggtttgctttgttgttatccattctaagggtaactaacttttgaaaggaagacgacgggtgagccacaataaattaaatgaacaagtgatcgagacgcggttaagaggatttgaagtccttgcgactcccctgttgaacaaaggggttgccttccctccggaggaaagggatgctctcggcttgacaggattgcttcctcccaaggtgctgacgcttgaagaacaggcaaaacgggcgtataaacagttccaatcacagcctgatgatttgagcaaaaacgtctatttaacggcgcttcatgatcgaaatgaagtgctgttctacaggcttctgaacgaccatatgacagaaatgctgccgattgtctataccccgactgtcggaacggcaatacagcaatacagccatgaatacagaaagccgcgggggctgtttttgtcggttaatgaccctgaaggcatgaaaacggcatttgaaaatctggccgctaaaagaagccggatcgatttgatcgtggccactgatgctgaaggaattctcggaatcggggattggggagtcggcggcatcgccatttcgatcggaaagcttgctgtttatactgcagctgcgggcatcgatcctaacagggtcctgccagtagtcattgatgcggggacgaaccaggaaaggcttctgaacgatccgctttatgtcgggaatcagcattcgaggatcaggggcgagcgttatgaatcgtttattgatcaatacgttcaaatcgcaaccgagacgtttccgggcgttttgctgcactgggaagatttcggaacgcagaacgcgcgtcagattttgaaaaaatacaaagacaaaatttgcacctttaatgatgacattcaaggcacaggagctgttaccctcgcagcggtgcttgcggccgttaaaatatcaaaaatgccgctgaaggatcataaagtggtcatatttggagcggggacggccggaatcggcaatgctgagcaaattcgcgccgcactcgttcaagagggagtgtcggaagaggaatcataccgccgtttttggtgtgttgatcggaacggtttgctgacagatgatatgaacgacttgcaggacattcaacaaccgtatgcaaggcctgctgacgaggtaaaagacttcagccggaacggcccgggggatgcaattgatctgctcgaggtggttaaaagagtgcagcctaccattttgattggaacctcgacggtatcgggcgcatttacagaggaaattgtaaaagaaatggcaaagcatgtgaaacggccggctatattcccgatgtccaatccgacgccgttatctgaagcaaggcctgaagatttgatcaattggacggaagggcgggcgctcgtcgccacaggaagcccgtttgcgcctgtggaatacagcggcacccgttatgcgatcggccaggcgaataatgcctttgtattccccggccttgggctcggaacgctcgtatcaaaagcaagactgattacggacaacatgttttacgccagcgcggctgcgatcgcgggtatggttgatacgggccggcccggcgccgcgcttcttccggaagttgaggatttgcgcacggtttccgcaaccgtggcaacggctgtcatcaaagcagccatagaagacggagttgcagaaaacgagccggacgatgtgattcaggcggtgcaggatgcgatgtggcatccggtctaccggccgattcgcgccatataaaaagatgcggccctgatggccgcatcttttttgatgctatgctgctgtatcaatcacatctacgatcatgcctgtttttgcatcaaccatgacttcgtactgttcgagctctccgaaagcggaacgcgtaatgcctgttttgtacaccatgacggtttcgccgtttacggtataggcttccggaacggtatatatccatgaaccgtcgatcgggcctctctgtttaaaagcggacttgacgatgcgcagcgctttttcagaagaaatgtaaggctgcatgacatattgtttgacaacgacggccgcggcaatgccgatgccggctccaataagaaagtggcgcagtttcatcctttcagcacctccaaagcttgtttttttcattatacagaacatgtccgtccgtgttaaggatgggctctcttctggaaacacatcgcacacttatgtaaaatgtagagagatacataagaaaagagggaaacagatgaatcaggaaacgagaacgctttttcaaacgcttacggagctccccggcgccccgggaaacgaacatcttgtccgtcgcttcatgaaaaaagagcttgaaaaatatgctgatgagatcatccaggacagacttggaagcgtgttcggcgttaaacatggacctgaaggcagtccaaaaattatggtggccggccatatggatgaagtggggtttatggtcacatcaattacagataacggcctgcttcggtttcaaacgctgggcggctggtggagtcaggttttattggcccagcgggtggaaatccacacggacaacggaccgatccccggcgtcatcgcgagcacgcctcctcatcttttgacagatgagcagaggagacgtccgatggatatcaaaaacatgatgattgatatcggggcggatgacagggaagatgccgaacgcatcggtgtcaaaccaggccagcaaatcgtaccgatctgtccgtttaccccgatggcaaatgaaaagaagatccttgcgaaagcatgggataaccgctacggctgcggactcagcattgaattgctgaaagaactgcaaggaacagaacttccgaacaatctttactcaggtgcgaccgtccaggaagagctcggaacaagaggcgcgcaaactgcggccaatatgatacagcctgacttgtttttcgcgcttgatgcaagtccggcaaacgattcgagcggcgacaaaaatcaatttggccagcttggcaaaggagtgctgttgaggattttcgaccggaccatggtgatgcacagcgaaatgagaaattttgtgctggatacggcagagacaaatgacatcccgtatcaatattttgtttctccgggaggaaccgacgccggccgtgttcacatctcaaatgaaggcgttccttcggccgtgattggcatttgttcaagatacatccatacatctgcttccattatccacgttgatgactaccttgctgcaaaagaattgctgatcaagcttgtcaaagcttgcgacagttctgccgtccagtcgattttgcgaaatgagtgaacaaagaaaccctgtgctgcttaacgcccagggtttctttttggaaaaacaactaccggctttcaaatacgtatgacaacgatttaattgcctgatttacagtttccacagtaatgttcgctttgtttgacagttcttttaacggatgatggagtgattcgggtcggatgatgatcagcggtttgcctttggcgatcgcgtatgatgcatccattgccgtgttccattgcttgtatttttccccgaaaagagcgatgacaacatccgccttgttcattaaaacggaagttctaaaattgttcaaatccgaggctgcatcatcctttgcgattgaatcagcctgcttgcccataatttcttcaccgatgttgtcggagcgctcgtgattttccatcggtccgacaaatgtgatcggcagcttgagcgattttgctttttccttcacctcttcgcgccaattgctatgtatttctccggcaagataaacgataaattccatacatgctcctcctgactgtcatgggatcacggcgcgaggcgccttaacggatatttttaccctattacttataatgttaaacgagaatggcttgataaagcaaaaaaattatgcttatgatatgaaagaggttcggatccttaagattttccctttttaaaacgggtaagatacataagaatcgtccatcttttaaaaaagccggcaggcagcaaaaggctggctatagagccggcagtctggtatgatccgaatggatgataagaacttatattggaggcgttgagtgatgaaaacgatcgagacgaatgaagaattgcaaaaagttgtgaaagacgatttatccttgttgatgttttcggctgactggtgtccggactgccgttttgtagaaccttttttgcccgagcttgaagcgaactatccggaatttacattctattatgttgaccgcgacaaatttatagacacgtgcgcggagtgggatattttcggaatcccaagcttcctcgtatttaaagaaggaaacgaaatcagccgctttgtcagcaaagaccggaaaacgaaagaggaaatcgagcaatttttgaccgattcactgaataagtagccgaaaggagagttcctctatgaaaatgacctcaaggaaactttccgatatattaaaaaaacgtttgcaaaatgacagctggtcctttcatttcgacagggaaaaggacagcttgagaatcgaagataaaaacactggaaaaggcattacactcgagctcccggggatcatcgcgaaatgggagcagaaaaaagatgatgcgattgacgaagtcgtctattatactgaggaagcgctcaacgccatgaaaggccagtcgcaggaaatggaaggacgggaaagcctgatctatcccgtcatccgctcaacttcctttcccgagaagtccagcgcaggcgttcccttggtttttgacggccacacggctgaaacacgaatttactatgcgctcgaccttggcaacacataccgtctgatcgacgaaaaaatgcttgaaaaagagggctggacaaaagaaaggattcgggaaacagcttcctttaaccttcgctcgctccagaccgttgtcaaagaagacgaagtcgcaggcaatcacttctactttttcagagcgaatgacggctatgacgccagcagggtgttgaacgaatcgattctcgcagagtatgagaaaaacgcggaagggaccctcgccgtgtcaattccgcaccaggatgtgctgattattgccgacatccgcaataatgccggatacgatatactcgggcaaatgtcgatgagcttttttgcaaacggcacagtgccgatcactgcgctttctttcctgtatgaggatggaaagcttgaaccgatctttattctggctaaaaaccgccctaaaaagaaatgatagaaaggaatttttctcatgaacgcattttataatccagaaggcgtaggcgatacgctgctcatctcattgaacgatattccacgtgaagagatcgcttttgagcggtacggagacgtcgtgaaaatttttcataaagacacaaaggaaacagcaggctataacatttttaatgcctcctcatatttgagcattgaggaaagcggagctattgcgctttccgaatcctttgtccaggatgtgaatgaaattctggtccgcaacggtttgaaagacgagctgaccgtcgacctttctccgaagtttgtggtcggatatgttgaagaaaaagaaaagcatccgaatgccgataaattaagtgtttgcaaagtgaatgtagggagcgagacgctgcaaatcgtctgcggagctcccaatgttgaagccggccaaaaagtcgtcgttgccaaagtcggcgccgtgatgcctagcggtatgatcattaaagatgcggaacttcgcggagtggcgtcaagcggcatgatttgttctgccaaggagctgaatctcccagacgcgccgaaggaaaaaggcattcttgttcttgacgacggccgtaaagcaggagaagcctttacattttaacggcataaaatgaacaaaactttcgaatagatgtaaaaagaagccgctgggtagacaaacttggcggcttttttattcggagggcggacgcttggagaaggacttgtccttttctgggtggggaagcagtggtatacttaaaaccgtccccgaaaaatttaagggagttagagagtgatgattcatgagctggtttaataaaatgttcagcctgtttttaggcgatgatgaagataatgaaaaacaaaaaaagcacatagacgaatttgaggcggattcatcttcagaggacgaagagatgccgcaaataaccgacgcaaaagtcgtatatgaatatccaaaagggaaattccgctttccggttatacctgatcaaaacacgcggccgcgggaaaaggacgacagccgcgaacaaaggacccgccgcccggcgagccgatattcagcttctcagccgaaacccggcaattcatatcattatgaagagaaagcggcggcgaaaaaaccttttaggccgtccgtcatcccatcaccggtttacggctttcatgagcagaaaagagccaagccggaaaatcatacatatcgtgcaaaaaaacaaactgaagcgcgtgtcacgctgtttaacgaagaaattgaaaaagagcagaagtctgcagaacataagcagccggtacgagaagaagcttccgtgcaaactgaaaagaacggccgtccgctgatcaaaagcgagagccgcaatcctgcattgcgcgccgaattcgaagatgtcccgcaggcatccacggagattccaaaagaaacggaaatccgtccagagcgaatgacagaaggcgcgggactcgcagaggaaaaagcgctgcgaaatgaagctgtagaagagaccgcctccgcatcacaaaacataacggaggaagacgcaatccccgctgagcaaacaccggaacaaatcgaaaagcttttggataagattgaggaaaccggagaagagatggtactggcagaggacgcagaagccgccacggaagaacaagggaagacttacggttcgggcaaaacgcatcccgacccggaagcttcagttccggaagagccgcacactcatggccgcgcctctgaaataaccgtccagagcgatgaatcttcccataggacagattcaaacaccccggctgacgctcttgaagaaacaagcggaagccgccagactggctggagacaagagcaggcgtcatgtttaccggaaacggcagcgccaagcgcgggtgaacccgaaagcaggcaagagaaccgggagactacaaggataaacgaggatcggccggaagctccgcggaagcgggaagcaggagccgctccgggatcgaagaaaggctctgttccgtttaatgtcatgatgtttgcctcagataaacaaaaagaaaaagcgcctcaagggtatcagttcccgaatatgtctttgcttgatgtgccgccggcgcaaaagcaggatgatcaggactggatacacgagcagcgggagctgttggacgtcacgcttgagaacttcaatgttaaagcaaatgtcgttcatgtcacccaagggccttctgtgacaagatttgaagttcatcctgaacccggagtgaaagtcaacaaaattacaaatctgtcagatgatattaaactcagcctgtcagcgaaagatattcggatcgaggcaccgatcccgggaaaaaatacgatcggaattgaagtgccgaatctgcacagcaaaatggtttatttacgcgaaatgatcagaagttcggaatttagaacgaatccgtctcctctgacagcagctctcggactcgacatatccggaaagcccgtcgtggctgatctgaaaaaaatgccccacggtttgattgccggtgctacgggatcaggaaaaagcgtatgcatcaacacgatcttagtaagcctgctgtttaaagcgtcgcctagggatgtaaagcttctgcttatcgatcctaagatggtggagcttgctccgtataataatattcctcatctcgtcagtcctgtcatcacagatgcaaaagcggcaaccgccgcattaaaatgggttgtcgaggaaatggaacggcgctatgaattatttgctcattccggtgttcgggaaattgagcgttttaatgaaaaagtccgggaacagaacatgggtgaaaaacttccttatcttgttgtcgtgattgatgaacttgccgatttaatgatggtcgctccgaatgaagtggaagagagcatctgccgaatcgcacaaaaagcaagagcgtgcggcatccatcttctgattgcgacgcagcggccttcagttgatgtcattaccggcttgattaaagccaatatcccaacaagaatagcgttttctgtttcaagcgctgtcgattcaagaacaattatcgatatggcgggagctgaaaagcttcttggaaaaggggatatgctgttcttggagaatggttcaggcaaaccggtccgcctgcaaggcaactttgtgtccgaccgggagattgatcgtgtcgtttcacatgtcagacggcagcaggagccgaactatttatttgaacaggaacaattggtcagacaaaatccggccggatttgaccacgatgaactgtttcttgaagcgtgcgaatttgccgtggaacaaaacagcgccagcacttcaagcctgcagcggcgcttccgcatcggctataacagagctgccagattaatcgatatgatggaaagggaaggcatgatttctgaagcgaaagggagcaagccgagagaagtcctgattacaaaggctgatctggaacagttaatagaaagtagttcacttttcggctaaacatggtatgatagctgatgggcgtgtttttttagagcgccgtatattaaagcgccgccagcggcgttttaatccgtttttaagagcacttccgtgaaaggggtcaaaaaaatcctttccgcaggaggtttattcgctcttgaaaatgcctgatactgaatataattatgactttgaagaaaacgatgcggccgggctttaggttgcaaattgaaataagcgtcatatactgggaagcagatagacgtttgttggaggtactattatgactgtttatcattttgtcggaataaaagggacaggtatgagtccgcttgcccaaattctccatgataatggatataatgtccaaggatcggatatcgaaaagtacatttttacacaaaccgctttagaggagagaaatatcccgatttatccgtttgatccggaaaatatcaagccgggaatgactgttattgccggaaatgcttttcccgacactcatcccgaaattgaaaaagcgcaagctgaaggcctgccagtcgtgcggtatcataaatttctcggcgattatctgaagaagtttacgagcattgccgtaacaggggcacacggcaaaacgtcaacgacgggccttttgtcacatgtcatcaaaaaagcaaaaccgacttcttatctgattggagacggaactggaaaaggctgcgaaaacagcgagtactttgtgcttgaagcctgtgaatacagaaggcattttctgagctatcagcccgattatgcaatcatgacaaatattgattttgatcatcccgattatttcgcgaatatcgatgatgtatttgatgcatttcagacgatggcattacaggtgaacaagggaattatcgcatgcggtgacgacgagtatttgatgaaaatccatgcgaacgttccagtcgtatactacggctttgccgaggaaaacgattttcaggcgagaaatgtcatcaaaaatactgagggcacaacgttcgatgttttcgtcaggaacacattctacgacactttctatataccggcatacggcagccataacgttctgaacgctttggccgtcatcgccctctgccattatgaacaggtcgatgtcgacatcattaaagaaggattgcaaacctttggcggcgttaaacgcagatttaacgaaaaacatgccggcagccaagtgctgattgacgattatgcccaccatccgactgaaatcacggtgacgattgaagcagccagacagaagtatccggaacgggacattgttgcagtatttcaaccgcatacatttacgcgcacgcagtcattcctgaatgagtttgccgaaagcctcaagaaagccgattatgtatatctttgcgatatattcggatctgcccgggaaaacgcaggaaagctgacgatcggtgatttgcaggagaaaattccgcaggcgaagctgatcgatgaaaatgacacatcaattttaaaggagcatgaaaatgcggtgttaattttcatgggcgcaggtgacattcaaaagtatttaagagcatatgaaaatgtattagcataacaagaaaaaggcagtgtgagtcaatccgctgcttttttgtacatatgaagcgggagtttctgttaaaggaattcacccgtgcgtatagaaaaagtaaatatagaggtttacgatttaaacaattgggtatacatcaattgtaagcccttagctgaaggaggataagatgattattattctgtatttaagcgctgcactcatcgctgttagctttcttattttggttatctatttatcaaaaacattaaaatcgcttcaagtcacacttaatcatgttgcatcaacgctggaaggtgtggaaggacaaatgaaaggcatcaccgctgaaacaacggagctcctgaataagacgaatcggctcgctgatgatattcaggaaaaatctttgaagctgaatacggtcgtggatgccgttcaggaagtcggcacatcggtcaggcagtttaacaactccattcagcaggtttcacagtccgtcacatcagccgcagagcaaaaccgtgaaaaaatttctcaagttgtcagctggagcaatgcagctttggaaatttggaatagatggaaacaaaagaagatgagggaggaataataaatgagtaaagacggaatgaatactaaggattttttaatcggcacgtttgtaggcggaatcatcggggcggctgcagctttatttttagcgccgaagtcggggaaagagcttcgcgatgaccttggaaatcaggccgtcgttttaaaggataagaccggaaagctcacaagcgaagcgagggagagaggctctgagtacgtcagcatcgccaaagagaagacatcttcgatttcacagcttgttgccgaccagtcttcacagattatggataaagtcaaagacttgcgaagcaagggtgccgaaaaagctggtgaactaaaggaagaagcatcgtctgcaatcgaagaacaggctgaagaagccaaaaatgaaatagaagatgaagcaaggaaaacagcagataccgctcagaaataactgtggaaagggagatcaccgtgtcgaaacagctcattcaaacagaggatgaatttaaaaggcttgcagaaaacaatgatacatttatctttttgaaacacagcgtgacatgcccgatcagcaggcgcgcgtttgaagaattcgaatcattcgccaatcagcatgaagacataccggcttattatttaaaagtgcaggaaagccgcccgctgtcaaactatatcgctgagcaatacgggattaagcacgaaagtcctcaagccttcatttttacaaacgggaatgtgaaatggcatgcctcccattcgcaaattaccgcacaagcacttgcggaaaacagcagataatccgctgctaaaaacggccaagacgtatagcgttttggccgttttctatgttgttatgatgcttttgcctcatggaaatgcctttttaggaaaatgtatcgtttgatccattggtgtgcgttataattaataaaacgggaggtgatcagttgaacactgaattaaaggacatgcttcaatccgttctaaaagaagaattgagtccgatcaatcagcgccttgatggaatcgacaagcgcttagacaaaatcgacgcacgcttcgttgagatagacaagcgcttcgatgaagtggacgcacgcttcgttgaagtagataagcgctttaacgcaatcgacaagcgcttcaaagaaatagacgggcgcttaaacaaagtagaaaaccgcttaaacgcaatggacaagcggctgaatcggcttgaaacagatatagatgaactgaaaagagggcaggagaggctcccgaaaacgatcatcgagaacatcggacaatttacggagaacattgtcgaacatgccgatgataaggcggctgccttgaatgacagggtttttagcgtcgaaaccgcaatacagagaatatacaggttatcaagttaaagaatcaaacatgattctttttttattcttccgataaacacccgcacagcaagggataaactgcatataatgctttatcacttaaaagcgtttgggtaataaagaattttttcgtgacattttaagaaacattgtttataataaaccctaatcaattgaatcattcttattttcatagagggtgaagttaaaagaaaggatggattaccatgagcaacactgaacttgatttgctgaggcagcaggcgaatgaattaaacttgcaaatattaaagctgattaacgagcgaggaagaatcgttcaggagattggaaaagcgaaggaagcacaaggcatcaaccgctacgatcctgtcagagaaagagcgatgctgaacgaaattattgaaaataacgacggaccgtttgaaaactcgacgatccagcatatcttcaaagagattttcaaagccgggcttgaactgcaggaagacgatcacagcaaagcgctgctcgtttctcgcaagaaaaagcctgaaaatacaatcgttgatctgaaaggcgaaaaaatcggcgacggagaacaaagatttatcgtcggtccgtgtgcggttgaaagctacgaacaagtagcggaagtcgcagcggcagctaaaaagcaaggcttgaaactgcttcgcggcggagctttcaaaccgcgtacaagcccgtacgacttccaaggcctcggcgtggaaggcctgcaaatcttaaagcgtgttgctgatgagtatgatctggccgtcatcagtgagatcgtgaatccgcagcatattgaagaagccattgattacatcgatgtcatccaaatcggcgcccgcaacatgcagaacttcgagctcttaaaagcggccggttcagtgaagaagccggttctgctgaagcgcggacttgccgcaacgctgaaggaattcatcaatgcagcggagtacatcatgtcgcagggcaatgatcaaatcatcctttgtgaacgcggaatcagaacgtatgaaacagcgactagaaatacgcttgatatctcagctgtgccgatcctgaagcaggaaactcaccttcctgtattcgtggatgtcactcattcaaccggacgccgcgacctgcttcttccgacagcaaaagcagcgcttgcgatcggagctgacggtgtcatggccgaggtccatcctgatccttctgtcgcgctttccgactcagctcagcaaatggatatcccgacatttgaaaaatggttaaatgaactgaagccgctcgttcaagtaaaagcataagatttgtttatggaccgctcgcgagcggtcctttttttacgttgtcatcaaaaattgtcgaaaaaatttcttatttttaagtaaaaagctgtttattcttatttaaattaattataaaaataaagggaacgttttcatattaggtaaaaccgtgtataatttcagagagccccttttgttttggcaggttatgaaaaataatgtaaactggtgttctgtttattttacataaagttttacattttgacatttctctacatgaaaatgtttatgctataggaaaagaaaagtgtacccagttaaggagtggtaaaaatgagtaatgtgacaatatatgatgtagcacgcgaagcaaatgtaagtatggcaaccgtttcccgggtcgtcaacgggaatccgaatgtcaagccgacgacgagaaagaaggtgcttgaagcgatcgagcgtcttggctatcgtccaaacgccgtggcaagagggctggcaagcaaaaagacgacgactgtcggcgtgatcattcccgatatttccagtatcttttattcagagctggcgaggggaatcgaagatatcgcaacgatgtacaagtacaatattattttgagcaattccgaccagaatatggacaaagaacttcatcttttgaatacgatgctaggaaagcaagttgacggtatcgtctttatgagcggaaatgtgactgaagagcatgtggaggaatttaagcgatcgccagttccgatcgtgcttgcggcatctgttgaagaaaaaggggaaacgccgtcggttgcgatcgattatgaacaggcgatttatgatgcggcaaccatgctgattgagaaaggccataagcgccttgcgttcgtctcaggacctatggctgaaccggttaatcaagcgaaaaaactgcaaggctttaaaagagcgcttggggataaggggctgcaatttaaggaagagtatgttgtagaaggcgattatacgtacgattcaggaatggaagcgctggaggctttaatgaagctggatgaaaaaccgacagccgtcctgtcagcgacagacgaaatggcgctcggcgttattcacgcagcacaggataaaggactggctgttccggatgaccttgaagtgatcggttttgacaatacaaggctttcattaatggttcggccgcagctgtcgactgtcgtccagcctacgtatgatatcggtgccgtggcgatgaggcttctgacaaagctgatgaacaaagaggaagtcgaagagcatattgtccagctgccgcatcgcattgaactcagacaatcaacaaaatgatcatcattaaataaacgagaaagaaagcaagtgttcacagcttttttcgtgaattgcttgctttcttttccttgagctggagagattatgaaaaaatgaaacgatttgattatctgacaccggtcggttttattctgggtattttcattttagtgctcggcgttgtctctggagcggggctttccggtttttattcgtttatcgatttgacgtctttttttattgtgacgggtggattgtgtgcagctgtattcatcagcttttccccgaaagatttaaaaagagcgccggctgtgctgaagcaggtctttatttcggaggaagatgatgtgcgcgaattggtcaaaacctttgtcagcctgtctgaacaggcgcgcaaacaaggaattttatcattggacgccaatgtcaatgaaatgaaagacccgtttttgaaaaaaggcctgctccttgccatcgacggatgggatgaggagacgatccgcaatgtgatgaactcggaaattgccgcgatggaagaacgacacagaaaggggagaaggatctttgaaaaagcaggagaatttgcgcctgcatggggaatgatcggaacgcttgtcggtctcgtcatgatgctcaaaaacctgaacaagccggaaacgctcggtccgaatatggcaatcgcccttttgacgacgctttacggatcacttttagccaacatgctgtttataccgatcgccgcgaagcttgaagaaaagacggagaatgaaatctttaagaagcaagtcatgatcgaaggcatcatcggcatccagtcgggaagaaatccgcgaaatcttgaaagtcagcttgtcgttttcagttcaaaagaagaatggacaaaaaagcgggcggaccgcatgaaacaaaaggacaggtctcatgaagcttagacatgaacgaaggaagcgcgagcagggccgcaaatcgccaaactggatcatcacgttttcggatttgattacgctcatcctcgtgttctttattttactgttttcgatgtcgcaaatcgatttaaacaaattcaaagcagcagtcggttcatttcaagacagggccgacggcaaatccgtcgcagagttgaaaaaagacgcgggcgatcagaaggctgaaaaaacggctaaaagccaagatgatttattaaagaaaatcaatgactatattgaaaaaaacgaactgtcaagtttgattgcggccaagcgtgacgaacggggcgtcattctcgtccttcaggaagcggttttgtttgattcagggaaagcggatctgaaagaccaagctcacccgcttttgcataaaatcgccgtccttctcaaatcggtgtccaacccgattcgtgtggaggggcatacggacagccgcccgatttcgacttaccgttttccatccaattgggagctttctgcagcaagggcgagcactgtgatcggctactttacgtcgaaggaaaagctcgactcgtcgcgttttcttgccatcggttatgcggatacaaaaccggtcagggacaaccgcactgagagccatatgaaggaaaacaggcgcgtcgagattgtcatcgcaaaacaataatgagaagaaagcaaggtcttgcacaaaagcaaggccttttctgtgtgccgcaattttcatattaagtggtacgctgggcagagcgaatcggataaagggctttggcaacggtttgtgcgtttttttccgttatttcggtttttcttggaattggaggatacaaatcttccgggtcggaccagttggcaggaagccggacagatgcctgtttcccccattttttcagccatttttcaggcattttctcctctggttccatccctttcatttcaagccagattcttgcccatgccctcggtacgacgcgccaaatgtcgtagccgcctccgccgacagcgatccatcttccgctgcaataggtgtgtgcaagttcgtgagcgagctttggaatctcttcgtaaatcttcatcgtcgtgcacaagtgtgtcagcggatcgtagtaatgtgcgtcagctccgttttgcgacaaaatgacatccggtttgaaaaactcggctatttcagaaacagccgtccggtaggaatcaagaaaagactcatcttctgtgaaggcatcgagtgggatattaaaagcatagccgtagccttcgccatgacctctttcctgaacctgccccgttcccgggaataggtagcggcctgtttcatgtatcgagacggtgcagacggaaggatcatcatagaacgtaaactgcaccccgtcgccgtgatgggcgtctgtatcaatatataaaactttcgcatgatattttttctgcaagtaacgtatcacaactgaactgtcattatagacgcaaaagcctgaagcccttcctctgaacccgtggtgaagcccgcctccaagattgagggcgtgtctagctttgcccgtcatgacatagtctgcagccgtcagcgttccgcctaccaaaagggaggcggcttcatgcatcccggcaaaaacaggggtatcctccgttccaagcccgtagttttcgctttcggctgccgggagctttcccgcccctgcaagctggacggccctgatataatcgcccgtgtgaacaagcttgagctcggtttctgtcgctgcgcgcggggcaatcgtttctcccggttcaaatgcgccgaccgtgttcaaaagatcgtatgttacatagactcgcagctgattaaacgggtggtcttgatgaaattgataggtttgatatgagggagaaaaaataaatacgctgtccttcatggcaaatccctttgaacagccggccaaagaacctgataccctttggattttacgtctttgatgatagaggcgggattcatcgtttgaacgcgaaacacgagtattttcgaatcatcttcatcaccgggatatacgagcacgctcaatatggcgatttggcgcctgctgaagatggcgctgatatcagcgaggcttcgggcgatatgatcggttttaatttcgatttgggagcctggaaaatgggctcctgtcagctgaacgaacgtatgcagcaaatcggattttgtcacgatgccgacaagctttccgttttttacgatcgggaggcagccgatttcgtgttcaaaaaagacggctgatatttcttcggcaaaatcaagcgggtgaccggtgatcacttctttggacatgatcagttccaccggcttttttaaatcttcgttagatctgttttgggcaaagatactcggacttgctgttttgacgtccctgtccgtgacaatgcctatgaccgttccccgttcattgatgacgggaaggtgctttatgtggaatgttcgcatgcgtttgatcgcttcttcaatcgtatcggttctggatagtgtcacaacatcccgtttcatgattttttcaacaatcatattcaggtcccctttgctcccttaatacataaaacgattgtggaatctgagtctgtcaaaacgctcgatcgattcctgactgacctcttttccgatgcgtgccattaaacagttggcgggatgggagctgatttccggatcgtctgtcgcaaaccagacaagtcctccggcattcatcatcttctccatcatctttctgtattcccaaacatctttgttagtcccctttagatcccaatgccagtaatattcagtcgtgatgataatatatttttccatctgcggatccatcatgctgaccgcaagcagcgtcttcccgacagagtgacctctgaacgccggaatgacttcgatggctccaagctcgattaaattttccatgtttccttcagaccatctttcaagcgggtctggataaacatatgtcacatagccgacaatggtttgccggaaacgggcgatgatgattcgtccttcgggaagccctgcgatttcgattaatgcttcatgttgtttttgtgatgggcgaaaggctgtaagctcgtcgtgaaattcatattctgcgagtttttcgggactgatagggccctctatcagcacagagcctttctcggtctgcaattctttggcatgataagttttgtgatgctccacgtatccaccgccttacatcttagttgaagtcttttatacataacataccaaaatattaagcgttttcataggagagaagagtattttttaaaaattgagaaaataaaaaatctatactataatatattttgatgatcgaacaaagggggatgggcatggaattgaaagcgctgccagcagaaaagggaaattacaacttgaaagactatgatgaaacataccggacatttgactggaaggatgccgaaaagcatttttcatggcacaaaacgggaaaaatcaatgcagcttatgaagctatcgaccgccacgctgagtcaaatttgaaaaacaaagtggcattttactacaaagatccggtccgcgaagaaaagtacactttcagagagatgaaaaatgaaaccaacaaagccgggaatgtcttaaagcagcatgccgatgtgggaaagggagaccgtgtgtttgtttttatgccgagatcgcccgagctttattttattcttctcggcgccatcaaattgggagcgatcgtcgggccgttatttgaagcgtttatggaaggtgccgtcaaagacaggcttgcaaacagcggagcgaaggtcatcgtgacgacgccggaattgcttgaacgggtgccggccgatgaacttccggatcttgaatcaatcattgtcgttggagaaggcgtaaaggaagaaggacctgtcattgattattacgcgaaagcggcggaagcaggcactgatcttgagattgaatgggtggatcaggaagacgggatgctgcttcactatacgtcgggttcgaccggcgcgccaaaaggggttctccacgtccataaagcaatgatccagcattatcaaacagccaaatgggttcttgatctgcatgacgatgacatctattggtgcaccgctgatcccggctgggtcaccggaacggtttacgggattttcggtccgtggctgaatggagctacgaatgttgtcgtaggcggcagattcagtcctgaggcatggtacgaaacgattgaaaaaatggaagtgacggtatggtacagcgcgccaacggctttccggatgctgatgggtgcaggcgacgatcttgtgaataaatataatctaagctccttgcggcatattttaagcgtaggggagccgttaaatcccgaagtcatcaggtgggggcataaagtcttcggcaaccggattcatgatacttggtggatgactgaaacaggatcgcagctcatctgcaattacccgtgcatggaaattaaaccgggatcaatgggcaagccgattcccggtgtagaggctgcaatcgtcgacaaccagggaaatgaactgcctccttacagaatgggaaatctcgccattaaaaaaggctggccgtcgatgatgcattcgatctggaacaatcctgaaaaatatagctcctattttatgccgggcgattggtatgtgtcaggagattccgcctacatggatgaagacgggtacttctggttccagggacggatcgacgatgtcatcatgacatcgggcgaacgcgtcggcccgtttgaagtcgagagcaagcttgttgagcatcaggccgtcgctgaagcaggcgtcatcggcaaaccggatcccgtccggggtgaaattattaaagcgttcatcgccttgagggacggttatgaaccgtcagatgcgttaaaagaagaaatcaggcagttcgtgaaacaaggcttggccgcacatgccgcgccaagggaaatcgaatttaaagataaactgccgaagacaagaagcggaaagatcatgagacgcgtcctgaaagcatgggagctgaaccttccggcaggcgatctctcatcgatggaagactgatgtctcattgacaatgcaaaaatattatgttaaaaaagatttagtcgaatattcaaaaggtgaagactgagatcagtagaacgcatccttccctgtcttagagagctgatggccggtgaaaatcagcacatatggatggtttgaattacactcatgaaccgcttttgcgaaaaaagccttccgggctttctgtagcagaagaacggaagcttttccgttatcaacgagagtgaaaagagcgcggccatgcgttcttttaagcagggtggtaccgcgatttttatcgtcccttcgtttttgcgaaggggcgttttattttggaaaaaaggagctaattgatgatgacacacatacttgatgatttgtccttcaggggactgattcagcagcaaaccgatgaagcaggcttgagagaactgctcgataaagagaaaatcagcttatactccggatttgatccgacagctgacagtctgcatatcggccacctgctgccgattttaatgcttcgccgcttccagctggccggacatcgtccgattgcgctcgtaggcggggcgacgggccttatcggcgatccgagcggaaagaaagcggagcgcacgctgaacaatgaagaaatcgtccgcgaatggtcgcagaaaatcaaaaaccagctttcgcgtttccttgattttgaagctgaagagaacccggcgatcatggcgaacaactatgactggatcggcaaaatgaacgtcattgatttcctgcgcgatgtcggcaaaaacttcggaatcaattacatgcttgccaaggatacggtaagctccagaatcgagacaggcatatcttatactgaattcagctacatgatcctgcagtctctcgatttcttgaatttgtacagaaaccaggaatgcaagcttcagatcggcggaagcgaccagtggggcaacatcacatcaggtctcgaactcatccgcaaatccgaagagaatgcaaaagctttcggattgacgattccgcttgtgacaaaagcagacggcacgaagttcggaaaaacggaaggcggcgcgatctggcttgataaagagaaaacgtcggcgtatgagttttatcagttctggatcaataccgacgacagggatgtcgtgaaatacttaaaatacttcactttcttatcaaaagaagaaattgaagatctcgctgaaaaaacagagacggcgcctgaaaaacgcgaagcgcaaaagcgcctcgccgaagaagtgaccgttcttgtacacggccgtgaagcgtttgagcaggccgtcaacatctcaaaagcactgttcagcggagatatcaaacaattgacagctgaagaagtaaaagtcggctttaaaggggttccttccctggaggtcgagaaagcggatgaacttcctcttgttgaaatactcgtccaatcaaagctgtctccgtctaaacggcaggcgcgcgaagatatcacgaatggcgcggtatacgttaacggcgagcgccgcaccgatgttgcggacgtcctcaccgccgacgaccgcatcgaaggacagtttaccgtcattcgccgcggtaaaaagaaatacttcctgctgacttataagtaatcaaaaaaactcttgccaaacggcaagggtttttttgtgtcaacatgtttcatgcatgttcattcaggaaatgtcaaaaatatagatgtaataggtaaagcgtttccatcgttgaagagggaggaatgtagcatgaacctgttcattgcagccaaagaaaaatttatggaagattaccacaagcagctggaaacggaacgaaaacaagaggtgcagcagtcggctgacggatacaatcaattgaatcagacggaaaatgcagcaaagcggctgaagtagagggtctttagaggccctcttttttatcaataaaacggccggcagtctctttacccacccgttttattgataacgatcgacagtttataatttgcatgatggtttaagtctattaaaaattggtccaactgttgatttgacggaaacttgcattcaagaagataacagccgtctccgctgattttatagttatgaatgatgtatttctgctgtgctttaataaatgaaagataaggcttatgataagtgctttttgtatagatattgataaaagcgtgaataaaacacccgagtttcacttgattcacttgtatggtataaccttcaatcactccttgatcctctaatttagcaacccttgctgaagccgcctgacctgtcaaatgaactttctctcctaattccttcatggtcatccggctgttttttgataattcctctatgatttgcttgtctgtatgatccagcatttcatcaaatcctctcaaatgaacgtttttcaaaaatcaagtcaaacgctgtaaagacttgattttatctatttaaatgttgatcggtcatagtataaactaatcgtaaatgaaaggaaaggcatgataactatgaatattcaacaaattcgaaatgcaacattggccgtcaaatatgcgggcaaaacatttttaatagatccgatgctggctgaaaaaggcgcttaccctcctttcccgaactcagcaagacaagagcaaaacaaccctttggtcagcctgcctgtgccaaccgacgagctcgtcaagaatacagacgcagtcatcgtcactcatctgcatttagatcattttgacgatgctgccaaagatctgcttccgaaagaaatcaaactgtttgtccaaaatgaagcagatgctgaggaagtgagaaaagccggttttcaaaatatagaggtcttaacaaaagatacggtgtttgaggggattcaattaatcaaaacaaaaggcgagcatgggaggggagagatattaaagcttgccggagaagtgtgcggcgttgtcttcaaacactcaaaggagaaaacgctgtatgtggcaggggatacagtttggtatgaaggtgtccgggaagaaatcgctgcgcatcagccggacgtcatagtcgttaacggaggagacaatcagttctttgaaggagggtctcttgtgatgggaaaagaggatattgctgaagtctatcaagctgcacctaaggccacaatcatttccagtcatatggaggctgtcaaccattggactttatcacgaaaagaattgaagagcttcattcaggaaaaaggaatgtcctcgcgcgtacttgtgccggatgacggcgaatcttacacattttaatatatgacaggtcaaagccgtaaaaaacagacagtgaacttctgtctgttttttaattcttcttcgagaccagagatgtaatcaatgcctccggcgggattcgaacccgcactccttccgtaagcataggctaggggagaacacgcttccctacggactttcaccgacaggaattccacctgtctcagctatttgcttttcggtgcttctgaaacccttgccttgcgacccgttcctacagtgttttacggcgctcttcccttctagagctacggaggcgaaatgaatgattcatattatacagaagcaatggttaaatggaaacggtatattgtttttcctatgatatgaatgtaagctcaaagcccatagaaaaaatgttctttccgaacaggcatcaaaacatcccttcaagtaaatggtcgaaaatgatattttatggtataattcatatgtttttcgcaaatttatagatttggcagtggaggaaattgtatgaagtggtattggagaggcttgaagaattatgcgaattttgaagggagagcaagacgaaaggaatactggttgtttcatgtatttaacggcatcatatgctttatattatttatcttatcattaatggtagtaagtttatttatttcaggaatcatgacagcttgaaggatatgacagatatcaagtaggatatattattgggtatggcggggggttcctcggatacattctcatctttatttatcagttggctgttttggtgccttctttggctgtcaatgtccgcaggctgcatgataccgggagaagcggctggtggattttaattggctttttgccgattatcggtgctgtcattctgcttattttttactgtcaggctggcgaagcaaaagaaaatcaatatggaccaaatccaaaagtaaatgtatcgtaaattggcccccaattgttagaaaatcatctggcgattggggtttttttatatactgaagcagacctgaatttttgattttattgagcaacccttcaataatatcatcggagctttgttcaatgtgccagcaataccgaagagtgtttggcggtatcactctcagcagcgattgaggatcgtatggtgataccggagaacagtcaaatcggcgagactaaataaaagcagtcgctgaagttcagttgtggctgcatcgcgacacggatctcggtcctttttcggaagctttttataaataaatcgcacaccatcccgctaaaacccccataacaaagcagtcgttgctgtccattttcttgccgtgtttaagaaagacattcaaagcccaattcagtttagtgccctccgccgtctttgtaacccattttttgctgatattgtagtacatgactttgaaaagggcgaatgcaactgaacagaatacgtagaacaagacaaacttagcaaaaaacaaaagcatttgtcggccactcctccgctttcaattgtctaaccaacgatttaattttaccgaagatgtttaaaggagaaaaggagatgtttgcttgtgagaaggtaccttactcttatgaggcgggtctgttttattccggcgggcgaatttcgaaccaggatgaatgtgatcacagatatcatttgaaagtgaatcatcagatctatcagcagccagaatcaacggggagtaaacaaaaaaccctagaatcgttgggatgtcaacaattctagggtttttgcccatgctctttaaagagcattttctattaacgagagtagaactcaacgatcagcgcttcgttaatctcagcaggaagctcagaacgctctggaaggcgagttagtgaaccttcaagcttttcagcgtcaaaagtcaggtattcaggaacaaagttgttcacttcaaccgcttctttaacgacagaaaggttttgagatttttcacgaagtgaaatcgtttggccaggtttaacttggtaagacggaatgtcaacgcggcttccgtcaacaagaacgtgaccgtggtttaccaattggcgtgcttggcggcgagtgcgcgccaggccaagacggtaaacgatgttgtcaagacgtgactcaagaagaatcatgaagttttcaccgtgtttaccggccattttcgcagctttgtcaaaaaggttgcggaattggcgttcgttcacaccgtacatatggcgaagcttttgcttttcttgcaattgcaaaccatattctgatagttttttacgctgtcccggaccgtgaggacctggtgcgtaaggacgtttttctaattctttacccgtaccgcttaaagagatgcctaaacggcgggataatttccagcttggacctgtatagcgagccataatgtgactcctcctttggttttatttttgtgaaaataaaacccatctgttcaattcagccatgtccattttgttttcatgtatcctcgctccagcagcaaagagttacacgatacaccttaataaataaggaacaaaatgaaacatagaagcagaacaaaaaggctgcattatttcacacaaagaagattatataatgtccgccgggcaaagtcaaccattcatggatcgtcccgaaaggaacggactgtttataagtatatagtcctgtttttgtgatataatcaggaaaataaaatacaaaaaacggattttttaaggtgatgaccatgaataaacaaactgaagacctatatctgacttttcatcaaaagctgtttcaattttttttaaaaaagccggccgtctcgtacgacgactctgttgcctggctaaaagcggcagcagagtcatttttttcgtttatatctctaacagtgcagccttcttcaagactgcagggatcgagaggcgacggtgatccgatcagacgagtgagcgattatcataccattataacaatagaagaaaacagcaaatatatagaactttcatgtcaaaagaaacataaattaccagaacgtctcgcggaatccattcatctgtttttggtgcattgtctggagcttgacgcattatttcgtgatgagcttaagaaaacaaagatttatgaaaagacggagctgctgcatgagctgatggatcaggagcaggtgctgaagacaatgctcgaaagcttaaggagtgtgtttccttttttaacgtattgtcttttcttgtcatacgatgaggatcaatacatcaacctccctgcgatagagttggatgtgcaaagcgaatcgaccgattcttttgccttggaggcatacttatcaggacaggagaagagcaaaaatgaagcggaagtatacattccgattaaaggccggcagggaacgtacggcgttttgaaagcctttggaccaggcgctgccgatacggcagcggatatatgcattatttcgaatgcggcagggaaagcatttgaaaattcacggctttacgaacagtcgcagaatatgatttcaaatttggagctgattaatgaaacatcgcatcagctgaaccggacgaaacgccttccggatatgatgaagagcttgtccgaaaggctgatcagttcattcggcgccgaagaggtgggctttttttataaaaatcacttaggaaaggaaaccctgctgccggaaagcactagtttttttcagacggatgaggcccttccatacatccgctatgtcaaagagaagatatcagaggaaaacggggtgtttgtcggaaacggttcttcgctttttgggaatgaaggatatgcttcattaatgggcgttccgatgctggaaaataatgaaaacaaagggtttgtcatcgtgttgaaaaaaaacgtctgctccttttcgtttgagatgtttaagctgtttcagacgctgatcaggcattccacgctcgccgtatcgaatttgatgctgcgcgaccggctgaagtatcttgttcagacagaccgtttgacagagctctactcgagaagccatctcgatgagaaaatcgggtacagtatgaaattggacgagagcggcgtcctcgtattgatcgatatcgatgattttaaacagattaacgatacgtacggccatcagaaaggcgatgatattcttatacaagtcgcccgggtgatccagcgaaacatccgcgatcaggatgtcgcagcaaggtggggaggagaagagcttgcggtatacttgccgaaagcaaggctgaacgccggtgaaatgcttgccgaaaggctcataatgcttgtcagggaatgtacggatccgacggtgacgatttcgtgcggggtatcccattggtctcaggatcgtccgaaatctttatccgacctttttaaagaagcggatgtcgcgctgtacaatgcaaagcggaacgggaaaaacaagtttatgacacattaaaaaagagccggaattaccggctcttttcgcttaaacgctctccaagcttctccgtgaactttttcaaataatactcatcagtttcatcgaagcggtttttaatcgggctgtcgatatcgagcactccgatgatgctcccgtcaacttcaagcggaactacgatttcggattgggacgctgcatcacacgcaatgtgtccggggaatgcgttcacatcttcaacgcgctcgacccggccgtttgtataagcggtgccgcagacgcctttcccgaacgggattcttacgcatgcaggaagtccctggaacggcccgagcacaagctcaccgtctttggcaaaataaaagcccgcccagttgacgtcttccaatgattgatacaaaagagcggaagcgtttgctgtattggcgatcatatcaggttcgccttctgtcagcgcatcgatctgtttgaggagaagctcgtattttttttctttactgccttctgttttttcgacatgaaacattatatttccctcgctttttctttgaaatggcaaaaacgcgcttgccgtgatgctatttgtcgagcgctttttacaggaacaactccgcttgaagtggaattgttttaagtaagaaggggtgaaacaagatgggatcaaacgctactccaaccacgaaggacaggatcatcgaatctgccgtggaactgttcaaccaaaaaggtttttcaggaacatcagtccgcgaaattgcccgagcagccaatgtcaatgtcgcccacatctcctattattttaatggaaaaggcgggttaatggagcatttagtatcccgtttttatgaaggctatttaagaatccttgaaaagggccatgaacgccttcaggatgcaggtgcaacggattgccttcttcaattggtttttgatattctatcgtatcagcatgaacatcgtcaattaactcggtttgtctatcgcgaagtcacgattgattccacactgaatcgtgaagtgatgtcgacatatttaacgaaagaaaagtacattctccatctgatcattgaaaagggaaatgaggacaacgaattttcccgttttcccctttcccattttatgattcagctgaagtcgcttttaatgatgccttatctgcagcctcaatatatttcagaagtgctttatgtacagccgcacgagccgtacttttatcaggcgtattacaaggaagtcaaaacatggcttctcagtctgttgtacagagagcgtcggcaagccgccgttatttaacaaagcggctctcaaaatgttcgtaaccaaatccggcatcctctgcttggtgggcgtcagacccaaagacaagcgggatgtttttttgttccgcttcttttatcatccattcttccatatagacgttgcctgcataaggcttgcggaggccggccgtattaaagtcaagttcaagtccgcgttttgcggcttcatccagacaggaggagaccgattttctaacgctttccgacatcgtatacggaaacagcttcacaaattttttcgcaagcgtgatgtggccgattcgttttggcttaaatgctcccaacggtgatacaatggaagaatagatttcgtcataataggcgagataaacctgctctgtgctgccgtagcagtcgatcagctgctgaaacgctttttcatcgtagtcaagacagatgtatgaagatccagccggcaaaaaatgaacggacaggatgctgtcgtcaagatgtgtgccgtactgatcgagaaaagctttcgtttcatgttcaaaggcgcggatataatcgacttcaagaccgatcaaaatgtcaagctgtcctctgtattcttccttcagttcggtcagccgttcaatatagcggcccagctgggagatcggcatggcgctgtctttctccggagtcggatcaataaatgaaggcggaagcggcgcgtgctcagtaaaggatacggattggaagccttttttgcacaattcttctatataatatctgaattcgtcttttgatccgtgcggacaaaagggagaatgaacatgaccgtctcgtttcagcatgatgtcaccccgtaaaaaaatagtcagatgttgtcactttgatgtaaaaaaattaaaaattctgctcaaaaaatgttggttacatggtatcataagaacaatgaaaacgatagtttaacttcatttttacataacaatttcaaatatcataccctgacagaacaagataaacagcaagggggctcattatggagtttgtcattggcttactggcgttatttttaatcttattcgctacgggctacttattcagaaaaaatatatataaagagatcgaccgtttagaagcttggaaaatcgaaatcatgaaccgttcgattgtggaagagatgtcaaaaatcaagcatctgaaaatgacggggcagactgaggaattctttgaaagatggcgccgggaatgggatgaaatcgtcacctcgcatatgcccaaagtcgaagagcttctgtttgaagccgaggattgcgccgacaaataccgttttcaaaaatcgaaacaggtgctcgcgcatattgagaatcttttatcagcggctgagtccaacattgaagacatcttaaaggaaatcgccgatcttgtctcaagcgaagagcagaaccgcaaagaaatcgaagaggtaaaagaacgttatacaaaagtgcggaaaaaccttttggcatacagccacctgtacggagacctctatgcgaaaattgaagccgacctcgataccgtgtgggaaggcattaaacagtttgaagaggaaacagaaggcggaaattacatagaagccagaaaggtgctgcttgcccaagaccgtttgcttgaagagcttcaatcatacatagacgatgtgccgaaactgcttgccagctgcaagcagacagttccgcaggaaatcgcaaaattgaaagccggctatcaggaaatgatcgataaagggtataagctcgatcatattcaagtggagaaggagctcgaaaaccttttgaaagaattgaagcgcgctgaagatgcgcttttggacgagcttgatttagaggaagccgccgcaatcgtgcagatcattgatgaaacgatccagacgctgtataaccagctcgagcatgaagtcgaagcagggcaggaaattttgggcaaagtgcctgagcttgccgctgcattggaaaagcttgaagcctccaaaaaggataccgaagctgaaaccgagctcgtcaagaaaggctacagactgactaccggcgaactggagaagcagcagtcatatgaaaagcgccttgaaatgatcgaaaagcagttcgaacaagtgagagaaaggcttgatcagaaacatgtcgcctactcgctgttaaaagaagagcttgccgatatcgaaaagcagatggaagccgcgcaacgggagcatgacgaatacagggacatgctgcaaatgctgagaaaagaagagcttcaggcaagagagcttctcaagcaattgaagcagacaatcaaggatacggcgcgcagcctggagaaaagcaatgttccaggcatcccggaggccataaccgaaaagatccgacagtcgcagacgactgtgcagaaagtgacagaacagttgaatgagctgccgctgaacatggatgcggtgaacgaacgtcttcaagaggcggaacagcttgtcacggaagtgaaaacaaagacggacgaactggttgaactggttttgctgatcgaacgcatcattcaatatggcaaccgcttcagaagccaggaccgtatcctttccgaacagctgaaagaagcagaaaactgtttttacgcatatcagtatgaagaggcttacgacatagccgccagagcggtggaaaaagcgtcgcctggagcagtggcccggcttgaagcggacgcgaagcagcctgaataaagcaaaaacccggcatgtaaagaaatcctcccggaaacgggaggatttttgttttactcaccagaagctgccgtacctttgggtgctgaagcatgcttgtccatttgacggcctgtgtcagcgtccttgagcttgagtgcgatgaaaagcgcagccatgaggaaaccggctgcacagagcaaagctgtccggtaagctgataaatcaggctctatgcctgcgctgggctggctgagcacagcaaggacgcacgacatgacagcaactccaaaggcagatccgagccggttttgcacattaaacagcgttgttgcccggcccattgaggatgatgaaatgttggcaaaacaaacaacctgcgccgcaccaaccgcgtgccccaagaaaaagcccgctaaaaacagcagcagcctgagaagccaaagatttgacccatatccggtcaggctcagcagcccaaacagcacagcagcgcctaacagcgcaacggaaatgacccgcctcgggccaagctttgccaacgacctcggcatcagctgggacgccagcatcaagcctaatgcttcgggaaacgtaatcagcgcagtatctgtcgcagagtagccgagtgcttcctgacacaacagcggaaatatatagagcatgccaagcagtccgcctgctgtcagaagcgaaatgacgctcatcattccaaaaacccggtccttcaataagcgaagttcaatcaacggatgctcagccttcagttcgacaaaaacgaggattgcgaggagcatcattcccccggcccctgctgcaagcacatccggagagccgaatccacgcgcaggcccctggctgagtgcaaaaaccgccaacgccattcccggcgccgccaaaaggaatccaagccaatcaaatctgcccgcttccggctccaaatgttcatgaagatacaacaggccaaacagcagaatgatcattccgatcggaatattaatgtaaaaaatccagcgccatgacagctgatctgtcagaaacccgctgatgatcggcccaaccgcaggcgcgacggcaattggaagaacgaggactctcgaaattttggcccgttcatgcggaggaaacgtcctgaacaagatcgccattcccaccggcgtaatcaacccgccgccggccccctggatcacgcgaaatgcgtttaacgccgccagattgtcagcgattccgcataaggcggatgcagctgtaaatatcgaaagcgcggctaggaaaacacgctttgtcccaaagcggtccccaagccagccggctgcgggaagacagaccgccaagctgactaagtatccgatgttaactgtgcctgcagcagacggcaatgtttgaaattcggtcatgattgcaggcaatgccatgttgatgacactcgcatccatcgcagccataaacatggctgttacatatacaatgctgacaaccgtcctttgattgaacggccttctattcattgctgaccgccgtgtacttctgcagcagcttgatgctgttcggcgagagatcggtccaattcgagctgatatagtcgatacaggcgctgcggctcgcttccccgcagacgacctcccaccctgccggaatatgaatgaaggccggccagagtgaatactggccatcctgattcattaaaacgacatatgtgccgtgttcattttcaaaaggatttgtcatcgctatctctccctacttatccgtatcttttttcaagtcgtccagcttttccgaaacccgacgtccgatttcggccagcggctccggctggcacaaatctttatgccggcaatccatatcatgaatatcaatgtttccgttcaaataaggtagccatgactccggatcgatcggatcaaaccattccggtatcacggttgatttgaaaaacagaatatcgccatgaaagacgcggggcttatattcgcttaaaatccggacggaattcacatacgtctcctttaagttcaagatcgcagcctcgtccaggctggcaagcgcactaccgtcgcggcgcagaatatcgatcgcactggaaaggttcagcggtgccccgtcaaggctgtccgggtcgtatcctcccaatgccaagagggcaatcaatgcttcctgctcatcaggcgcatctttaattggaaggaagtgattcgggtaagcatcaagcatgacaagaagcgatatgtcttccccttgttcctgcagctgagttgcgatcgcatgaacaacattgcctccgagggaccagccgagcagacgataagggcctgttggctgaatcgtacgaatgtgccgaatataatcagcagccatgtcgtcgagcgtatcaggtagctcttcctgccttgcgatcccgcgggcttgaaggccgtatatcgggtattccttgccgagtgccgtcattaaaccggcataacaccagctgaggcctccggccgggtgcacacagaacaggggatcttgactgcctccggttctcagcggaagcattacatccagcgcactttgcctgccgccggattcaagccgttcagcaagtccgctgactgtaggcgcttcaagcaggtcgccgatgccgagttcgactccgagcgcttcacgaatgcggctcatcagctgtacggcgagaagagaatgcccgccaagttcgaagaatccgtcatcaataccgactctcagcgcattgaggatttctgaaaaaagatcgcacaggatttcttcctgcggtgttcttgggccccgccctttaacagccgcggcaaagtcaggctcaggcagcgcttttcggtcaagtttgccatttggagtcaatggcagctctgaaatttttacaaatgcggaaggcaccatgtactccggcagagtgcctgcggcaaaccggcgcagctcagccggatcggtttcttcttcagacgccgggacaacgtaggcgatcagacgcttgtccccgggctggccttcccttacgaccacagcggcttgattcactctatgatggcggacaagcaccgcttctatctcgccgagttcgattctgaagccgcggatcttgatctgctggtcggcccgccccatataatccagagagccgtcctggcgcctgcgggcaagatcgccggtgcggtacatccgggttcccggcggaccaaacggatcagcgacaaagcggtctgctgtcaaatcgggtctgcccaagtaaccccgtgcgagaccgcccccggacacatacatctctccggtgacgcccgggggcaccggttcaagatactcatcaagcacatatacacctaaatcgggaatcccctggccgatcaggctgttcgcttgaagtgccgcagtctgctgatcgagagaaatatagctgacatgcaccgtcgtttctgtaattccatacatattaatcagccgcgggaaatgatccggatggcgttcataccaatcttcaagcctcttcagctcgagcgcttcccctccaaaaatgataaagcgcaaggaaaggagctttcctgtctcagcattgtcccggtcagcctgcatcaattgataaaatgctgaaggagtctgattgagcacagtcactccctcgcgaacgagaagattgagaaattcggccggcgagcggctgattgtatgaggcaccacgataagccggcccccattgagaagtgctccccaaatttcccataccgaaaagtcaaatgcgtaagaatgaaacatcgtccaaacatcgtcagcgccgaaatggaaccattggtcagtcgctccgaacagccgcacgacattttgatgcggaacaacgactcctttcggcttgccggtcgaaccggatgtgtaaatgacatacgccgggtgaagaggcagcaaaggcgcggtgcggtcggcatcacacggattcgcagcagcgcatcctttcagttcctcttgtatacaaggatcatcgagtacaatcctttcaacagatccgggaacagaaagatttgattctaccgctgaactcgttacgatgcagacaggatgggcatcattcaacataaacgctatcctttccgccgggtagtccggatctaggggcacatatgccgcgccagccttcagcactgcaagcaatccgacaaccatatccaaagatcttggcagcgccagggcagcaaattgttcggggccaacccctttggcgatcaggagatgagcaagccggttagcgcgtttattaagctcgccgtatgtgagcgcattattttcacatataaccgcaacagcttccggatcctttgccgcctgcttttcaaacaaaacgggcaaagatgaacaaggtatgctgttggacgatttgctccaatcagccagcatgttttcccgttcggccggaaggagaatatcgagtttttcgatcggctgatcagggtcgtctgctgctgaatccagcagcctgacaagccgttctgccaatgtttgaaccgtatttcgctcaaataaatctgtgctgtattcaagaaatccgccgatacctgcgggtgttccgtccgcttttcgatgttcgcgaagctcaatcgtcaaatcaaacttggctgctccgacgctgcgaatttcaatgtctgacttgaggccggaaaggtcaagctcaggttcaggcgtattttgaaaggcaagcataatttggaacagcggatgtctcgctcttgacctgcgcggattaagcacttcaacaagacgctcgaacggaaggtcctgatgctcatacgctgcaaggtttacttttctgactctgttcagaagctcccgaaaactcggattacccgatgtatctgttcgaagcacaagcgtattaacaaacaatccgacaatttcgcctaaagcatcatcgtttcttcccgctatcgggctgccgagcggaatatcatggcctgctccgagccgtgtcagtagtgcggcaagagccgactgcaaaatcataaacatgctgactccggtgctgcgggacaaatcgaacaggcggccgtgcagctgttcgtcaatgctgagatcaatcgtaccgcctctgtagctagattccgacggacgcgggtgatcagtcggaagctccagctgatcaggcagatgttccaatgccttcgaccaatattcgagctgtttggcaatcagactgtccggattgttctcactgccaagcagatattcctgccatacggcatagtcggcatattgtatagaaagcggctcccaaacaggtgcctcaccttgcagacgcgcattataggcggtttccaaatcacgggtcagcggcattaaagaccagccgtcgccgatcatatggtgcaaaagcagaagaagcacaaatttgtccggtccgagtacgaatagctgggcgcgaaacggaggctccttttctaaatggaaacggtgccggacggcctcagccaggactttttccaactcatgttcgctgacatgggatacagtgagttcgggacgcgcttgatccgcttccaatatcagctggtgtgttgtcccttgctgatccgggaaaattgttcgaagcggctcatgtcttgttgccacatcacccagagcagctgccagcgccttttggtccaaatctccagttaaatgaacgacaaccggaatattataggtcgggctcggtccttccaaacagtgcaaaaaccataggcgccgctgtgcgaaggacagcggaatctccttgcggcgctctcttttgcgcaatgccggacgggcgctctgcgcctgatcaagctgtttggcaagtccggcggctgtgggctcatcgaataaacggccgattccgagttcgacgccgagcatttcccgaatgcggccgacgagcctgcctgccagaagggaatgtccgccgaggtcaaaaaagctgtcatcaatactgactcgcggcacccccagcacctcagcaaataaatcacacaaaatttcctcttgcggagtcctcggctcgcgtccgcctgtatgcatactcaccgccggagccggcagggatttgcggtcaagctttccgttcggcgtaagcggcagttcatcgagtatgacaaatgcagacggaatcatatagtcgggcagtgtctcaccaacgtagcggcgaagctcggcaggatcaaggctttctcccgaagcgggaacggcatacgcgaataaacgcgggtcaccgggctggtcttcacgaacgatagcagcagcttgtttaacaaccggatgatttgcaagcaccgcttctatttctcccatttcaattcggaacccccgaattttgacttgatggtctgcacggccgatataatcaagcgacccgtcttcgcgccagcgcacgatgtcgcctgtccggtacatccgcgatccaggcggcccgtatggattcgcaataaagcgctcagccgtgagagcatgtcggttcaagtagccgcgcgctacccctgttcctgccacataaagttctccagccgttcccggaggcactggctgtaatccggcgtccaggacataaagctgcgtattccaaatcgcacagccgattcccggaggttccgtacagttgccttccagcgcagcggctgtagaccaaatcgttgtttccgtcggtccataaaggttcgttaaagaacacgcgagctgctgcaattgccgggccaggctggattgcaaagcttcgccgccgacaagcgcacgaagacctttgagcttgtccggggcgctcgaggccaatgcatgccagagggtcggtgtagcctgcattattgtaatttcgtatgtttcaatcattttggccaattcggacggatcttgtaccgtttccttctcggcaagaacgactgctgatccgctgatcagcggcaaataaatttcgagtgctgagatgtcgaatgcaattgtagtgacggccagcagccggtcatcttgattaagcgcgaacatgtcctgcattgacagcaaaaaattgaataagctttcagcttgtacgaccacgcctttaggtctgccggttgatcccgacgtataaatcatatatgccggctggttgccggaatgctgttcgccgggattttcttcagaacagccggacattttctccataacagtttgttcatcgaggattaacttcggcatttgcgaaccgatcgtgtcttgcgcttccttgctggtcataacaagcagcggctgtgcatcgttgagcatatactcgatcctgtcagccggataatcgggatctataggtaaataagccgctccagctttgagaacggcgagcatgctgacaaccatttccgctgaccgcggcaacgccaaggcaataaatgtctcgggtttcgccccctgatcgatcagcaagtgagccagttgattagccttttgatttaattcggaataagtgagaaccttatcattgcaaacgactgccggagattcaggacactcctttgccatcctttcaaatcgctgcggaagactctctttgggaagcccgtgttctgtttgattccattcaatcaatatttgagcgcgttcttcagggagaagaatgtccaacgtccccaccggctgagtttgttcgcaaacggcaatcgttttcagaagagtaagaaaacgattgccgtgatcttcaagttcatccgcatgataaacagcagggtttgcatccatgtttacttttagcccgccaccgtccggacggccgtaaatgttgattgacaaatcgtccacaggtcccgtggcaagattatgcacgatgccttgacagccggcaaaattcaagcggttctcaaaaggcatcaaattaagctgcggaccgaacagccgctggttttcgccaagcagcttgagatcccggcgcaattcttcgtggcggtaatgctgatggcgccgcagcttcatcatctcacccgagatttgcttgactagctctcctatgctcatttgcggctgcatgccaattcgaagcgggaggagattcatgaccattcccggaatatgaagagcggctgacccgaggcggcacatcatcggcatcccgagaacgacgtcatttgcccctgtcagacggtgaacatatattgctgctgctgccatcacggtttcgtgccaagttgcccccattctgctcgcggcagacagaagacgatcagcatcctcacttggcaggtgttcagacctgcgaagaaaacttgaagaggtacgcggcgccctttcggcaaggctgaccacctccggttcatcgctgaaacgcccaagccaaaatcgccgatcttcctgatactgttctgatgcacggtaagccgtttcctccgcgagaatcaaatcgagggagccaaaggctccgctctggtcgatcgatttgttctgcatcaatgcggtatatatttttgacagccgctcggcgatcaatgtaaagctgaacccgtctgttgcgatatggtgagttcgctgataccagaagtaatgatcttgcgccgctttaaaaagcgcttctgtaaaaagcgggccgcgagtcagatcaaccggacgggcaaggtcatccatcatccagcttttagccgcctgttccggatcggtttctgagctgacatcaatgtaatgtagcggaaaatctgttgacggaacgatctcttgccatggtccgtcttgatcttctccaaatctggcatgaaatgattcagcttctttaatgacatggcgcagcgctttttcgaaaagctcctgatcaagcgggcctttaatttcaacgtattcagctgtattgtagatcggattttccggatcaagctgctgagcaaaccaaatgccggcttgcgctcctgataatggctttcggttatgttgacattcaggcatttaggtgacctccttcattgatagtctgcatttggcaaaggtgcttctttagaggaggacaacagtctccaccagttttcaatcgaagggtcctccgcaagctctacaaacgacacctcccgccccgctcggcgccagcgctctgcgagactcatgattctcacggaatcaattccccggtagatcaaattttcgctgtcgcttatcttttccggcgattcaagaagaagcgatgccacctgttcgcgaataatctgttttgtcagtgcatgagagctttcttttgcgtgttcatggctttcgccatctttcagtcggctcagaagctgttccgcagtaattgtgacactgcaacggtcagctgcgtatgtgatggccatttcatgatgctttaatgagaaatccgccaccgcatctccgacgaaaaatgtttcaatatcttgcataaaagcatcacatgccgtcatcaggcagccgatatgggcatagattccggtgattatgagctgatcccgcccctgctcctccagcacgcctaaaaggttggtttttctgaaggcattgtacctccacttggtcaaaacaatgtcgccttcattcggtttcagctcatccacgatcttctgctcatcgggatcaggaccgattccgggtccccaaaagtcttggagaagcccccgttcttccggtgtctgggcgccgggttgagccgtgaaaataaccggcatgccgagctcggcacatcgcttccgaagcttcttgatattagccagcagatctgtgaccggagactcgccgtaacggtaagcgttgagaaaatattgctgcatatcgtggatcagaagcgccgcacgcttcggatgaggagtccatgacaccttgtttttcggcatatttgatgcttctggcatttggtacggtaagatggcaggaatggccatcaaatcacatcctctcattttttatcatctgacattctcagctgcagacattttttcagcaatcgccgcacgcagctcttttttgctgacttttcctacgcctgtctgcgggaaatcttcaaccatttctacccggtcgggtattttgtaggctgcaaggcccctttctctcaaaaacgattgcaactcagcctgagccggtgcagcgccgcgagggataatatatgcacacgccctttcgccgagaaattgatccggcatcgagacaaccgccgcatcgagtacccccggatgtgcgagcagatggttttccacttcttccgcggcaaccttctcaccgcctctgttgatctggtctttagctcgtccttcaacaatcaaatagcctgatgaattgactttaaccaagtctcccgtacggtaaaacccgtcttcagtgaacgctttggcattgtgctcctcagctttgtaatagccgcgaatcgtatatggacctcttgtcagcagctctcctgtctgtccgggtccaagttcgcgtcctttttcgtccacaattttaatctcgtcaaacggagacattggcctgccttgtgtgtgaacgatcgtgtcttcaggatcatcaagtctggtatagttgaccagaccttctgccatgccataaacctgctgcagtttgcagccaaacaccgatgaaacgcgtctggcagcttcggcgctgaatttcgctccgccgacttgaaggacctggaggcttgacaagtcgtcccggcgcgccgaagcagcatcaagccagattaacgcaagcggcggtacgagtcccgtgatcgttaccctctccttatcgatcagagggaaggtttcatccgggctgcctcctgatgcaaggacgactcggcctcccgcgtacagcgtaccgagcactcccggcgagctgagcggataattgtgagcgatcggaagagccgcaagatatacgctgttgtgatcgagcctgcaaatctctgcgctgaccctcaagctgtatatataatcatcatgcgtcctcgggatcagcttggacagacctgtgcttccccccgacaactgaagaaaggcgacatcttctggatagacgttttgcggaggtgccggctgatcataaaggcttgccagcgcttcaaactcctccggttccccggcgacaatgacatgacggagcccttgcagcttctcctttacctgtctcgccagcttgcggtagtcaaactttgcgtgacgatcgggaataatgtaggcagcagcttcagaaaactcgcaaaaatacgtgatctcgctatgccgatgcgatggaagcgcaaaaacaggcagagctccgatccggaagagcgcaaagcaaacttcaaaaaactcgatgatattcggcagctggacaacgacgcgatcattttttttgatccccagctttaaaagaccgccagccaaagaatcggctctcctgtctaactcacgatagcttaaatggatatctccgtatgtaagggcaatgcggcttccgtatttttcggcccgctccctcagcatttttccaaaagtttcgcctcgccagcatccctccttccgatatttatccgcaaactccttcggccatgtcgtgcatcctttcagcatctctatccctccgttactcactgttcattcccatcgcaagaagcattgtccgaaactttgcagacgtttcggcaagttcgtcttcaggcttcgacccggcgacaattccggcacctgcgtacagtcgaagcgcgtgttcctccgcctcggcacagcgaatcgttacaacccattctccgtcaccgtccgcgtcgcaccagccgaccatacctgtgaaaaacccgcggtcaaacggctcaatctgtttaatcgcttctttcgccgcattcgtcggcgtgccgcagacagcgggcgtcggatgaagggcggcggcaagctccaatgatgatacagagaggtctgtaagctctccctttaattccgttgaaagatgccacatcgtcggcgtgctgatgagcgacggttccggcacctccagcttccggcaaaacggcctgagcgcggaagcaaccgcttcgacaacgaccgcatgttcgtgacggtctttaggcgaagcaagcagttcagccgcccgtcttcgatcttcttcgggatcatcgctccgaggtcttgaacctgctaaaggatttgccgtaacgcggaacccggaccgtgatacaagcagttcgggactcgcgcctatcaaagtggtgcgaggcgcttcagatgactgcccggttaaatcaacggcaaagttgtacccgcttgtattgcggcgggcaagatttcgcagcaattgaccgatatcgactttgatcggcgaggtcagctgcaatgaccgggaaaggacgatcttgctgtattctcctgctgctatacctgccaatccttgtctgactccggccatatacgcttccgggcttggaatctgctggacatcataggggtgcagggcaggttcaggcacctctttatcgtcttcttcacatgtcagcggccccgcatgccacgcttcgaccggcacggttaactgcgccggctttgcatcgtcaaatggcacagctccaactacaatcggattttcctgcccgttctccctggcttttttcagaacttccgcagtccgctgagcaaggctttgctcttcggtttgagaaacagaagcaaaaacaccttccgccagaatggtccgctcaggggaagagaaaaagaatgaagcaccggcctgatattcctttaacagctgatctgcaagcgcttctgacacgacatgacgttctatcatcatcaaaacctcctttagattgaatcaggctccaagcgttgctccgccatcgacgcgcaaatcgtgcatcgtaatatgacgagccccgtcagacagcaaaaatactacagcatctgcaatgtcagccggcgaagccaattttccgagcgggattcccgttttgaatgtttcaagtgatccttcaatgacgccttgcgcagcttcctcacactgccatagcgaccgctgcatcggggtatccgttgatccgggcgatatgatattgcagcggatattgtactcggcaagttcaaggccgaggcatttcgtaaacattaaagcggccgccttggaggccgcgtaggcggccatgtgcatccgcggcacagctgccgcatttgatccgacagtcacgatcgctccagtcctgcgcggtaccatccggcgggcgacggcacgcgatacgttaaaaaccccggtggagttgacattgaacgtcttctcccaatcttcatcactcaacgaatggatcagacccgttctgagcacgccggctacattgacaagcatgtctatcggaccgatctcgcgttcaatatcggcgataagctggtcaactgcggcactgtcgcccacatccgcggcaaaacctgaaccctgcagtcctttttgttcaagttcgtcttcaagttcaagcagcccttttcgattttgatcagccgctgcaacaaacaccccgcgtccagcaagcgccagggccacttctttgccgattccttgcgaagccccagtcaccaaagcaaccttgcctttcacttttatcatttcctttcttaaagccggcagcgcccgagtctcaaaaagtcactgccggctaaaattccaattgataatgataatcattatcgtttaaaaatataatataccaataactgctaacggtcaaatcgttttcgattgtttatccgtatcaatgcgcttggtatattatcagttatctattctcatgctttttcaaagctcggggcgccggaagcgccccgctatcaatcaggcttgaaggcaaaccgcagcgctctgctgattaacacaggcagaaccgatatatgaccttcccctttaaattcatggtactccgcgcgaaccccctgactttccaaagcggccaagcggtcggccagcctttttgcattgtcgttcatcccgcttttatgcgtcttttcgagttctccggccccaagcaatacctttacatcgccatcagcttcctgcaacttcgaaacaaagtcatgctctttatcaaaaaatgacggatgccaatggatggacggactgccggcgatatatgtctgaaatagatccggttttgtaaacagggtctgcaggacaaaaagtccgcctagggaatgaccgaaaatcgcctgccttttcacatcaatcgtgaattcctgttcgatctccggctttaactgctgttcgatgaaggacagaaaagctttcgccccgcctggttccggccagtctgctccatcgggcctcatgggcagctcagcgcccgattccggcagagtaaaatcataataccgcccccggtcaaagggagcgtcggtctcgtaaccgatgccgacaataacagccgtccctacaccggttttatcgggacggcgcgactgcatccgcaacgcctccaccatcgttccaaacacggaattggcatcaagcagataaatcacgggatatcctgcgggcggctgttccccaaatggtttcgcaataaaaatccgatatgtgcggctcccatccagtgaacgcatgcaccgctgttctgtccccggtatcgcaaccgggatgcattcagcagcattgacagactgctgaagtttttcttgagccatatcattctcccttcccctctttgatgagctaaaaaacagtctaatgaacagtctttttttgtttgaaaagtaaaaataagaagtacggcacaccgaaaatggcgagaatgatacccgcaggcacctcggacggctggaacagcagctttccggcaaaatcggcgcacaatacgagaaacatcccgatcaatccgcttaacagcaatgagtggcggtgcaggacgccggcgagcctccgcgagatgtgcggagcaatcaggccgacaaatgccatgctccccgaaatagccacacaggcgctgataatgccgacacaagccgtgagcagcaccaccttttcaatattcgcggatacgccgagactcttcaccgtatcttcatgaaagcgaatggtatcgagcaggccggacttcatcagcagaaatggaataagaacaagcagccacggcagtgccgcttgaatatacgtccaattcgccgaccagatgcttccgtttttccaaaccgtggccatttcgtggtcattcggattcatcttcaatgacaggtaaagcgaaacagcgctgaaccctgaattaatcgcgattccaacgagaataatcctgcccgaatccaagttgccggcgtgccaggcaaagataaaaatgaatattgcagccaaaatgcccccgatcaagccgaagaatggcatccccattgcagcgagcaggcttgtcgtttcggtctggccttgaaagatcagcatgtagccgacgatcgccgcccccgcacctgcattaatccccaggattcccgggtcggccagtccgttccttgtcatcgcctggatgacggaaccggcaatgccgagcccaagacccacgagtgccgccgtcacaatccttggaagacgcagctcaaacaggagaatggcgtattgctcattcgggttgatgtgaagcaatgttgataacagctcagccggatgtacggcaaacgatcctactgttatgctgagataacagattgtgagaatcagcacaataaaaacagcatagatgactgcaacctttttaggcacgctgctcccctccttttctcttgatcaaataaaggaagaaaggaacgccgatcaccgaagtaacgacttcaatcggtgtctcaaacggatagttgatcagccggctgagaagatcggccagcgtcaaaaaaacgccgccgagaacgcaggagcacgggatcagccggctgtaatccgatccgacgagaaaacgcgtaatgtgcggcacgaccagtccgacaaaagcaatttttcccgccatggcgacagagcagcctgtcagaacgacgaccgctgccatcgctgtccatttgacggcctgctttttctggccgaggctttcggaaatgtcatcgcccaatgataaagctgtcacttttttgctgagagagagcgccagaatgatgccgatcacaaaaaacggcacggcatacttcagcagctcgggattcaattgatgcagcctcgcgctgtaccagaagctgacgtcctgggaaatttgaaagtaaatcgatatcgccgcagacagactgctgagcagcatgcttgttaccgtcccgattatggcaagttgaaccggcataaaaccgtttggaatcaccgaggcgaggccgaagacaaggccggcgccgacggctgatccgataaacgaatagcccatcatctccagagaggatgaacccggaatcaccaccatcaacagcgtgatcacaaacgctgacccgtcggaaacgcccataatcgacggggaagccaagtaatttcgggtgacaccctgcataagcgcaccggacaccgccagcgccgctccgattaaaagagcgccgacagcgcgcggaagacgggaatgccaaatgatttgatgatctgtgttgcctggatcaaaatgcagcagcgccgaaaaaatcacctcgggctcaagctgttttgcaccgtaacataccgacagaaaaacagacagcagtatggcaaacggagcggcgatcataatgatgcgggtcatttgctttgaatgcatagctcaatgaaccttttctatttgttctgcgccaatttctcagctgcagcctttaaaaattcaaccttgctccatgccgttccgccctgcgcaagcgggtctacagcattgacaaatacacggtcatttttcactgcagaaatgcttttccaaattggatttttctctagatctttcagcgcattcggattgtcggcattctcatcgtctgagaattggacaaacatatagtccggattcatttcactcagtttttctaaagaaaccaactcctgggcttttgccgccttgacttcttttggagctgtgaagccgagctcaccgtataatgtggaattgaagaatacgtcttccggatagataaagatattgccttttctgattctgacaacgagcgcttttgtatcttttgccgttttctcaagctttgttttagcttccttgaggtcggcttcataatccgaaataatctgcttcgctttatcttctttgcctgtcagttcagccagcagctttaaattgtctttccagtttgaagaaacatgggaaacaggaatcgtcgtcgcgatgttatccagttttttcaccactttatcaggaaatttcgttgaagccaggatgacatccggtttcagctcaaggattttctccaggttcggctccattttttcgccgacagcggttgctttgtcagtaatgctcttaaacagatccgggaactttccggagaaggaaatggcaccggctgggtgaacatccagaagcttggcatcttccatcgattccacgcttcccgtaatgacgatttgttcggccgggatcttcaccttgtatgtatgatcgaggtactcgatgctcttctcagctgacgctgtgctcttgccatcgccgccagccttttctttgctgttcccgcatcccgctgcgccaagcgcgagaaggagaataaatagaaatattgatatttttctcatctgactgagaccccctgatttaattgataactattatcaattaaaattataggtaagcctcttcgataacaccatggataatatccggcaattaaaatggattttttccggacagcagccgaaccgcctggcggatgattcgttcatggctgcatgcggaatattcccgccaaggatcagaattcacctgatacacccggtgatgccgcaccgctttcaaatcctgccaagcagccgactgctgaagctccctgtagaatgccagcgtctccggctctttaaaaatgaaaatcataatgatatccggctgataggctgcgattgtttcgatcgacacggcccggtcagtcggttcttccagcgacacagccgattcaaagccaaggtcgccgaaaaatacatcttgaacagaacggttatgcgccagataaatctcgtgtttatgcaagcgcaaaaacaaaaagcttcggcgtccgcagatcggataaagcgcctctttcgcggtctcggtgagacgctggtaagacagcagccatttgtgagcctccgcttcttcgtccaaatgggatgcggtcagcataaaatgcctcctccattgttcctgtgaaggcaaaaagaagacatccgcgatcgactggagctgttcccgctcctcgtgagacacgctgtccatgctgataatgagctccgggtcagccgatgacaatgtccacaggttttcttcccacggctcgtgaaagcggtatgcgctcagatggaccggaatatctgccgcgtaatgcttatagtaatatgatgtccacttcggatgcagggaagcggcgtaaggaatgaggtgaagcggtatcagctgtccgatcgtgttctggccgtaggcagccagctttctgcgcctttttttcatataaacggtcggggataagcctgtatgcttcttaaacgtcctgctgaaataaaattcatcctgatatccgatttggcttgaaatttccctcagcttgtagctcgcttttgccatcagctgcttcgctttcgtcatccgcgtctcagtgataaactctgtcacgctttgaccgtacagctttttgaacgtttcgctgtagtgcttcgcgctgattccggccatttgcgcgagttgatcaagcgtcaggtgtgcatctgaatgctcctcaatatactcctttgtttttcctatggctgatgcggtgttttcgggatgagtcagtttggccgaatagatatcgtacagaagctgctgcagatctgcttggcatttcagctcctggagcgctgaagatgccggccataaggcggaaagttcctgaagacgggaggccagatttccgacaggatggacattcatcatctgaaggtcggaaaaagcgtcagggtcggtgtctgcttgaagcgtcaggcggcggtcttcatagcagtagggctgcagcctgatgagataaacgctgatttcctctgacgaagctgtgattccgaatgtttcataaggcggaacgatatacagcgtttctttttggaggggtctgcctgatgcttgtatatcgattctgccttcacccttcaaatgaaagatcaaaacgaaagagtctgcgagctgctgttcatccggaagatcgccgggctttcttatatgatcaatttgcaagagacgatagaaataagaagatttcatagaaaaaccgcctttcttaacccagtgatattacaaaaaataaaaatgcccctaaaacaatatggtaaattggttgcggggtgcttgtccggcacaaaataccagtttgcaaggtgcatttcacatcacttatagctgatatgcttcttacgatttactataacacagtcacttttattgtggaataatgtatccaaagagaccatctgcccaatccgcactttaaaatataataaaaaatcaatacttatcatttcaatatccttttacctagtgtataactatagagaaattactatatttacagggaaggcgtgacttcttattttggaaatgacagacagcatgaaaaaatcgcttgatgcgattgcaaaatggggaaaaataaccggagtttttatgattatcgccggaggcatctatgcctttttcggaatttctttgcttatcatcggagccgctccaggtgtgctgatgattttttcaggaatctatcttcttaaatcggcaaacgccgctcagaaaatgagtcatgacatgccgcaagaaccgcatgaagccttgcttgataactatgtgaagtttatgaaatggcaatttttctacttactatcgaatattgtgatcttcattttatgcataatcgtttttttcttcctgatctttttaggtgttctagccgattcttacagcgggtatgatccttattattacgaatgatgatcaaaagcctgtctcggatcaatttccgagacaggcttttattattgagcttctccgacaacagtgaaacgctcattgacatgctcgcctttttcagcctcgtccaccactgcaatggcgtagtctgcatagctgatgtagctttctccggcggtgtttacgattaagttttcctgacctttttgataagaacctgttcgctttccttccggattaaaaaatgccgccgggctgatgaacgtccatttcagtccatctgcttctttcaaatcctgaaggttctgcccctgatttttagccgtcggcaagtattctttaggaaactcaggcgtatcgtacagctgggttgttttttcctcatcgacataaaggctgcctgcaccgcctacgacgattaatcttgtttcaggaacctgcttaaacagttcaatcagctttcttccagcttcaacatggagatgctcctgccctggggccgcgccgaatgcattgacgacaacatccagtcctttgatgtctgccgctgtcaggttgaaaatgtctttttcaatgacagctgcatcgctgttcgccatttttgacgcacttctgacaattgccgtcacttcgtgtcctctttctgatgcttcttttaaaatcatgctgcccgctttaccgcttgcaccgataataccgattttcataatcgcttcctccaataatttgattatttgtaacaagatttgttacatgttgatgatgaaacatcatctcttgtttaaaagagatgagttaagacgtctttaagagacttgctggccaattcgttctccatcgcctgctgaacgctgtgaaacgtttgatcaagcgttgtttgaatttgtcttccaaccggacagtttggattcggcttgtcatgaatcgcaaataattcctcatgcggctgaaccgcgcggtaaatatcaagcagagatatatcttcgggatctcttttcaggcttgccccggccactcccggccgcgacgtcagaataccggcttttttgagctggctgatcatgcgcctgattacaaccgggttcgtattaacgctcccggcgatcatttccgaagattcccgcgggtttgcggcgattaaagacaatatatgaatggccactgaaagacgggtgttcaccatatgttttcaccaccgatgtaattattatagttacaggtcacgtttttgtcaactcttatcatatccttaatgatcgcaagaataaataaaaattttttcaaaccctcacgtctcacttcggaactttttcacagtctctttcgtatctactgatgaaaggagtgtttttcaatgaaggagataacagaaggaaaagcagctttggatagccggcttgagccgaatgaagagatcagatctattattctttgcgcttataacgcgagactgtctgcacgttacactccgtacagaggcgtgcttgccgccactgacaggcggttcatgttttattcctccctgtttggctccccttttcatcttgacatccgctatgatgccgtcacctcgtttcgccgcgaaaaagggctggtaacaagaggcgatcatctcgtcgtgatgaacaacggggatcgggaagcatttcaatattttagcggctgtgatcctttagagacattcgtcgaagccgttcgaaagctaaagaaactgcctgaagacatcattcattctgaaaaacgccggctccgggatgtgcccgcagccggctgctcagttattaatatcgtacttctctccatacctcagcactttataaattgccattccatcagaaagatgattttcggaatacctcacgggaatcaaagcaaaaaatacataataggttgaaaaataaacaaattggtagaaaaaaatattttcgggtatgatgtctttgataatcagcagattgataataaatatagacattaagttaaacagcgatccgccagcataaatcatcgcattcgtgaaacggttatcgtattttaaatccccgtatttgcagaaggaatccatgaagtagacacttctgatttgaacagggccgattttcagcaattttttgcccatcccgatttcaagcgaagatttcccgccgaacaacaccgccatggcgctgtggcccaagacatgaagcaccgacacggcaggaaaaacgatcaagaacgaccagaggaatttgacaatatcctgcagtccgaacattcaatcatcctttctgtttcaggcaatgttttttaagaaaatttccgcttttcccccgtatcaaacctgtcaatatgcaaaacaagcagacctcagcatgaaaaaaaccgcccatctactctatggacggccttctcaggagcagtcaattatcctccaatataggacatttcaacctttttccgcggaaccgcttttgcaagagcgcggtcgagagaatattggtcatcgcgattccgccagacggtgccgatcgcctccgccagctcctgatcggtctgcccgcttctgatcaaggttcttaaatcaaacccgcttgatgcgaaaagacatgtgaaaagctcgcctttcgccgatagtcttgctctgttgcatgtggtgcaaaaagcatcggatacagaagagataaaaccgatttctcctgagccgtccaggtatcggtatcgttttgcgacttctccttcgtagttcgggtcgatcggttcaatcggcatatcttcattgatgatccggatgatatccgctttggccaccactgactgacggttccattcatttgtgttcccgacatccataaactcaataaaccgcaaaatatggcctttttctttgaaatagcgggccatcggcaaaatatccttctcattgacccctttctggacgaccatgttgatcttgacgccgagtccggcctttttcgccgcttcaattccggccagcaccttgctgacggaaacgcctcttccgttgatcgatttgaaacgctcatcatccagggaatccaggctgaccgttacacgtttcagccccgcttttttcagcttgtcagcgtaaaccggcagcaaaacgccgttcgttgtcatcgcaatatcgcgaatccctttgatccctgcaagcttcccgactaattccggcatatcttttctcatcagcggctctccgccggtgagacggattttttctaccccgaactgatgaacaaacagcttggccaatcgttcaagctcttcaaaggacaacagttcgccttttggcaaaaacggataatcctgcccaaagatttctgcaggcatgcaatacgtacatcttaagttgcagcggtcggtgacagaaattcttaaatcccgaagcggccggcttttctgatccaaaacttgttcactgttggtgttcacgcctgttgcctccttttatgaaaactgaattcgctcgtgatgcgtgtatacattgaatgaccggtttctcgcaaaaccaatcgtcatgatattcagctcctctgccatctgaatggccagctcggtcggcgccgacttggaaatgaccgcggaaaccccgattttcgcggctttaagcagcacttccgaagaaattctgccgctgaatacgatcagcttatcgcgcacaggaacctgatgaagcaaacaatatccgtacaatttatcaagcgcattatgccttccgatatcagatctgactgcaatcagcttgtctgtgctgcacaaagcggcattatgaacgccccccgtatggtgaaaaagcttgctgcttttctgcatgtcgcgcatcagcttcaaacagttctctggcgtaatggtcacgccgtcaatcgctgtttttgcggttttgacgtcctgctggaaataaaaatgcctcccttttccgcagcaggagccgatcacccgctttgtgtaatccttcagctgcagcttttttgtgctgacaaggtcgacatatgcgaacccgaggctttcatctattgtaaaccttttaatctcatttttaaatcggatcaccccttcagatgcgagaaatccgatcaccagttcttccaggctgtccggcgagcaaacaagcgtgacaaattcctcgccgttcaccatgacagtcagggggaattccgtcgccatctgatcttcttgctgcaccagctctccattatcataacggaaaatttttcggcttgttgtgatgtttttccccatgaataactccgcccctttgtttcttactatatctattactatactcgtctatcatgccgtttcacaaccgtcaggtcaaatttggaagcttcatcttgttgatagcttgaaaacatgatattattttttaaaagttcaaaaaatattcacttttcaaacagactgcccttcttcgcagcaacttcggaaaccgctttcaaacaatcgctccccggcagccttctgtctttattacagcctttttcaacagggggttctcacatgaaaaaagcgaaaaacaggtggctcattgctttatgtgctgtaggcattcatttgtcaatcgggtcggtatacgcatggagcgtctttacaaacccgctcgctgaaaccttcggctggagcctcagccagatcagtctgacgttcagcatcgctattttatttctcgggctttcagccgcatttttgggacacttcgtcgaaaaacacggccccaaaaaagcaggcatgctcgccgcacttttcttcggagctggcgtgacgttttccggcttcgccgttcagatcggctcccttcccctgctttatttgttttatggagtcttcggagggatcggactcggcgtcggctatattacacccgtatcttcgcttgttaaatggtttcctgaccgccgcggcttggccacagggcttgccattatgggcttcggatttgcggctttgatcagcagcccgatcatgcaaaagctgatctcagcggtcggtatagccaacaccttttttattctcggcatctgctactttcttgtgatgatgctctcttcgctttacctcgccccgcctgaagaaggctggcagcctgaaggattttcaaccggaaaaagcggaagagcacaaagcgctgatatttcccagctgacggcaaatgaagcgattaaaacgaaacgcttttattatttatggctgatgctttttattaatgttacgtgcggaatcgccatcatatcaatcgcttcaccgctggcgcaggaaagtgcgggcatgtccgccgccgcggccgccgcgctcgtcggcgttttgggcgcatttaacggtttagggcgcatcggctgggcctctgtatctgattacatcggacggccgaatacgtataccgtctttttcgccatacagctgatcgccttcccgcttttgccgttcatttccgacaaggccgccttctctgttttgatggcattgatctatacgtgctatggcggagggtttgccgcaattccggcttatatcggggatttgttcggaacaaagcagctcggtgcgatccacggatacattttaacggcttgggcggcggcagggcttgcaggcccgatgttctcttcttgggtacgcgatgcaacagggagctacagccaaagcctgacggtgtttgcggcactgttcgccatcgccctgttcatttcgatattcattagaacggacattaaacagttgcggaaaaaagcggcggttcatgtctcaaactcgctaaaaggatgatctgcagtatccgctggaaaggagagaagggaatgggaaaaacaaagcatcaaggtccgatgaagctgaataaaaagcccgcgccaaaactgtgggcgtcttgggcgccgatgggactcggaaaggtaaagccgaagcatatcagagatacgatgaaaacagcgtgggacaataaagacaaccttccgtacgcctacagaattttgacgcaaggcgtgtgcgacggctgtgcgctcggtgtgtccggactccgcgatcagacgctcacaggccctcatttatgcacgacgcggctgaacgtcctgcgcttaaatacaatgcctgcgatcgaggacaaatggctgtccgccgacatcgaacagctgcgaaagctggacagcaccgagctgagaaagcttggacgcatcccctatccgctgtcgagaaaaaatggtgaacgatcgttctcgagaatttcgtgggatgaagcgctcagccgaatcgcggacaaaatcaaatcgattgataaacggcagctcgccttttatttaacagccagaggcataacgaatgaggtgtactatacggccgcaaaagcggcgcggtttatcggcacaaacaacattgacaacgcctcgcggatctgccactcgccaagcaaaacggctttaaaaaggtcccttggcatcggcgcctcaagctgcagctaccgagactggatcggaacggatgtcctcgtcttctgggggtctgtcgctgccaataatcagccggtgtcaacaaaatacatgtatgccgccaaaaaagcgggaacgaaaatcattatgatcaatccgtaccgggagccatcgatggagaaatactggattccatcgatacctgagagcgcccttttcggcaccaaaatcaccgatgatgtttaccaagtcaatatcggcggcgacattgcctttatgaacggggtgatgaagcactggtttgaaatggagcgggaggcaccaggttcaagcattgaccgcgcctttatcgatgcacacacaaacgggttcactgagcttaaacagcacatcgaaaaacaaaattggaagacgcttgaagagtcatccggcatatcaaaagagagaatgaaagaattagccgtcttgctggcccgggcgaaaaccggcgttttcatttggagcatggggctcacacagcaccgttttgcgaccgacaacatttcacaggtggcaaatctcgcccttttacaaggattcatcggcagaaagcattgcggcgttatgccgatcagagggcacagcggtgtgcagggctctggagaaatgggtgccgatcctttcgtcctcccaggcggtgattttgacgaggaaaatgccgcacggatcgagaaggtttggggcttccgcttaccgacttggcaaggcgatacgatcggccagacgatcgaaaacatgctgctgccgagcggaagcgaaagaaaagtaaaagtgttttatacaagcggaggaaactttttggagacgatgccgaaccctgattttatcaaaaaagcattgcaggaagttgaagtgagagtccatcaggacatcatcttcaatacctctaccctggtcgatgccaaagaggaagtcatcattctccctgcgatgacaaggtatgaacagcctggcggaggaacctcgaccagtacggaacggatggtatacttcagccccgaaattaaaggaccgcgcatcggagaagcccgttcagaatgggaaatttatgtagatctcgccaaacgggtccggcccgaagacaaagaactgatccattttgacggcgctgcggaaatccgtgaagaaatcgctgctgccaaccggaattatgacgggattcagcatttaaaaaaacgcggagatgtctttcaatggggcggcgcctggctttgtgaaggcggtgtttgtccgacggcagacggcaggggcaacctgatccctgtcgatcttcctgaaaacagacaaacggaaggacgctttctcgttacgacaaggcgcggaaaacagttcaactcgatgatttatagtgaaaaagatcctttcaacgctgcagatcgccgggatgtcatgatcaatccaaaagatgccgaggagctttatattcaagatggagaagcgatcgttctattcaaccgctacggaactttccaagggcgggcaaaatatgccggcgtacaacgcggaaacacggcagtctactggccggaaggaaatgtgctgatccctaaaggcgtatacgaaaaccatgcccgtattccggaatacaacacggcggtcatgattgaaaaggcggagattttccattcgagaaaagatccgcgctatgcagaaaaacgaatcgaagaactcgaaatgtcgaccgattagcttaacagtcgggacggctctgctgccgtcccgttctcgtatggagttactgagacagttttacgccttcttctttccatacctttttaaaatcagaagctgagtcggcttcaatcaattttccgccgccggcgtcagctacttttttaagctttgctttttctttcacggtttttacatccagcccaacaatgttgacgatcgttttaatgttggatttgcgcagatcttttgctgcctgaacaggatcccctccgcatgtttcttcaccgtctgtcacgatgtagacataattcttcccatctttatcggcaagatcatcttttacatcataaagagattttgcaatcggagaccagcctgtaggcttgattccgcttaaagcgttttcgaatgaattgaaagaaaacggctgcagatcatagacggtttcagtcgtaccgcaggatacttcttttcctgagtttttattgttgcctttatgtccgaaaacattcagcatgacattcgcatcgcttgaaagcaggtcggcaaaatcggttacggattctttggaaatatcaaattttctttctccttcaaccttttgtgccatgctgccgcttgcgtcaagcacaactgcaacattgacatcttttttgctgttgtccgcatttccgttttcagccgcaaaagctgctgccggcgccaatgacaaaagcatggtgaacgttgtcaacagagcaaacctctttttcaactttctcactttcctttccgcatttgttttttcggaccgatcttccgcatgagatcaagtccaccaacatcgtaaaagaaggcttgatagaaataaataggccggatctccttttcaaattcacaaattcttcataatccttacgataatcgatcgacgcattcacttaagacctatcaaaaaagtctgctaaaaggccgatttcatcccaataaagctaccgttacgacaaataacccctccaaaggacgcagcagggttcaacgctctgacacaataacttaatatttgtaaagtatttttcttgacttttgacaatcttttcatcacaaaaggaaagctgcggaaacatgtccacagcttttttccagtttatttagaaagctcaattgcttcctgagtaaaaattcttttgatgtcatttttagtttttgcctggaaatattcaccgccgccagctgctgcgatactggtcaattgtccgtggaagtctccttcataatcaaagccgatcacgttgacaaccgcattggatttgcgcagttctgttgcgacttttaccggattgcctccgcatgtttcctcaccgtctgtcagcagatagacgacgtttttcccgttgttgtccagctggtcaagcgcgttttttgcatcttgcagcgcgtttgcgatcggtgtccatccggtcggtccgatgccgtttaaggaattgcggaagctttgctcgtcatacgtttggaagccgtacacccctctgattgcattgcaggactgcacttttccggaatttttattgtttccctctgaaccgaaaactctcatgagcacgtttgcattttcaagcttggaaccaaagctgaacgcttcatttttggcaagctcgtattttgagaccccgccgatctttttagccatgctgccgcttgcatcaagcataatcgcaacgttgggcgcatcttcggcaactgttacctcctgttttttctcagctgcaaaagcaggcgaaccaagactgagaaccatagcggtcaaaatgcccaatgtcatcttcttcttcatttctccctttcccctttctgaaataaagtcgttaacacattattatcgtagaagaacaccagggagaaataaatagggcatgtctccttttcctcgttattcaattcatcatacaacaagtatataaaatagactttataacctgtgacccctattgttgatacggcgtttgcggccttttgacgctgttcagcaagccctccggcacatgtttttagaaatatttgtataataatttagcgtgcatcaaattcatgggaatgccaaatttcgatgatattcaaaaagacgccgccaagaggcagacgtcttttgttttattttttcgccatgtatttatttaaaaattcatctgcattggatacggctgttcctttgtaataatacttgacgatgtcttctgctttcttgccgtctttcgccatataatgcgcaccgtattggctcattcccactccatgtccaaatccccttgtcgtgactgtaatctgattcccgtcgcgtttccaatcaaagtctgccgatttgaggccgagcttttcgcgaatatctcttccctcaagcttctttccattgatgacggcagtcgctacgcgttttcccggcgttctttcggtgatctctccgatgctgtttgaaccgggcagcttgacaccgagcttttgttcaaattcagcgacagtaaacgttttatggttcaggaatttcggcgattttgtgtcccaggagcttttcacgctttgcaggtacggaatatcacttgtccaataagctccggcattctcggtgtacccgttgctcgtcgagaagaacgaagcatcaataggcttatgctcataggttaaaattttgccttgcgtactggctacagcttcggtcacctttttgattttccaatcgtaatccttcttccacagcctgcggagctcctctttgtttttatacacctggaacatctgcgtatcatcgaccagcgagcctttcggcgactgtacagcttgctctgacaccatttgcctcacaatgtatgtgcgggctgccagcgcttgtgcttttaaagcttcgatatcaaaatctgccggcatttccgaggcaacgacaccgatgacatactcttcaagcggaatgtcttcaactttccggtcagccgttctgtagaccggaattgaaacgggagactcttttaaggtgactttctttttttcctcgtgttgctgagcgtgtttctctgttttaattgcccccggtcccccgtgaaaagggaggacaagcagtgttggtatgagtaaaatcagcgtgcagattcctgctagtacaattatgagctgtttcaaatcagtgcccccatttctgttttgtctctttcattttatgggcggggacaagctaatatgactgtactttttcaactgctgctacgtattttaaaagcaattcttgtgcataatgatagatatgggaggcatactgatatagaatacttgaaacgcaaaaatcagtatgccgtatgacatactgatttcaggttgatttatgcatttaaatcggatacaacttctttattttcaatatgaactgcttcttcatcgttaacgcgctcaatatcagcgccgagaccggcaagtttttggtggaagttgacatatccacggtctaaatgttttaattcggttacgcgtgtatgaccgtcagcaacaaggccagcaaggataagagctgcgccggcgcgaagatccgttgcggcaacttcagcgccttgaagctgcacaggaccattaatgatgacagaacggccttcgattttaatatctccgttcatacggcggaattcttccgcgtgcatgaagcggttctcaaagacggtttctgtgatcatgctggttccatttgcgcgcatcaaaagagccatcatctgtgactgcatatcagtcgggaaacctggatgtggcattgtttttaaatcaataggcttcaattcagaaggaccgatgatccgaagaccgtctccttcttccaagatttgaacgcccatttcttccattttcgcaattaaagatgttaagtgctcaggaaccgctccctttaccagtacgttcccttcggtaatcgccgcggcaaccatgaacgttcccgcctctatccggtcaggaataatcgtatgttttgccccatgaagcgccttaacgccttcaattttaatggtgcctgtaccggcaccccgaattttaccgcccattgcattgatatagttagccagatcaacgatttcaggctctttagcagcattttcgagagttgtcgtgccctcagccaaagctgcagccataatcaggttttcagttgctccgacactagggaaatcaaggtaaattttcgctccttgaaggcggccttctacagtcgcttcaataaagccgtttccgaccttaatttttgcccccattgcttcaaagcctttcagatgctgatcgatcggtcttgaaccgattgcacatcctccaggcaaagccactctcgaatggcctgtgcgagcaagaagcggacccatcaccaatacggatgcgcgcattttacgaacatattcgaacggagcttccgtagacaaagtgcgagatgcatcaaccgttactgtattattttcaaaatgtacacttgcgcctaaatgacgtaacacttcgttaatcgtatatacatcggagagcgtaggcacatcacatattacgcttttttcttcactggctaataaagatgcagcgataactggtaaaacggcattttttgctccttcaactttgactgtgccgtttaactttcgaccgccgcggacgatgattttttccaaggtattcccctccgcgtcccaatttctctatattaatattcagtcgtgacgattggtgtgccaaccgtgacggtaagtttttcgcccattcccgcatttctaagcgagacttgcaaattcatacggtgtttttctgtcttgatggattctttccactcgttagtgtaagcagaaatagaaacgaaatttggttcaattaaatcttcaactgactttgcatcaaattcatgtactagctcatttgcttttttttgcaaaacaacattcatcataccatttaaatggccctttagacaagtaaaaattgcggtcttttctcgcattatgtcgaatgcatcccgttcaaactgcttatatgtagcattccagttttcccgtggtcccgcgcctttttgctcatacaataaatacgaaacaagtctctggtttttgtgggtggataccaaatgtattttggaattgatatgattttttttgtcctgaaaaacacctgtcgctttaactgtatcgtcgtcttcccgcgttaaagtccattcatattgtcgatgctgtttcttgaaatgtttcagttttgcaaaaaaatctttttcacttagggtaagctgtttttttgtatgcatggtccactcttcaagctcgacatcatggcggctcaaaccttccgccagctgttcaagcggcgtattgcccgctgcttcaagcgattgaaagacatgaacaattaaaaataaaaccacactaaaaataagggcattaaccgtttgttttgtcttcattctgcatcatcctctcctactctccattgttgacggatcgcaggaaaagcatacgtggaaaaacaaggtctccggtgattttgcagaacgcggtgttacccatattcgtccattcccataaattctttttcttttactcaatcatgaaaataaattttgaagctgtctggaataataaagatagtccaagaaaaaattgctgacggtggagccgacggcgattgtaatgatgatcattaacaccctcgcctgaatgacttttcctttcctgataagcggatcaatattgaccgccagaagagcccaccaagtcaatgcaataaaaaaaagatgaacgatgatactgacagcagcctgttgtccgatctcttccattattgatgacgcctccttacgttcagccggtttggtgcttccggccagcctcgtctcttctgccgtaggataaaggaatgttgctggtcatttcaagtcattttaacagttttgatgttgcatgttaagtcgttcatgatagaactttttcccatagatggagtgatcctctgttgcctgaggggcttgtgttttaggagcttacttgaatgtcttacgtcctctttttggtggaagagaacatagcttactattttgtattatagatagattcatactaaaaaggcgaacaatttgtgaacatttttcaacattttcaattctgtttgatcttgaatataaaagacccttcccatccttaaatatgggaaggatccttatctctatctcgcaacatccaaccggttaatcgcgcgttttaaagcaagctctgcccgaataatgtcaacatctggagtttgcttttgcaaacgttcctcggcacgccgttttgcggccaaggcgcgttctttgtcaatttgttcagatgtttccgccgtctgggccagaatggtgacatggtcagggcggacttccactatccccccgctgacggcaaccagctcagtttgaccgtcttttttcagacggactgcagcaatttttagcggagcaaccgtcggaatatggccgggtaaaataccaagctcaccgctctctgctctaacgcttaccatttctatatccgcatcgtatactgggccgtcgggagtaacgatattgacttttaaggtcttcatgcttttaccctcctaggaccagattatacttctacacccatttctttcgctttttcgacaacttcttcgattcggccgacaaggcggaaagcgtcctcaggaaggtgatcatacttaccttcaaggatttctttgaagccttttaccgtttctttgacaggtacgtaagaacctttttgtcctgtaaactgttcagctacgtggaagttttgcgacaggaagaattgtacgcggcgcgcacggctgacgacaagcttatcttcgtctgacaactcatccattccgagcatcgcgatgatatcctgaagctctttgtagcgctgcaggatctgctgaacgctgcgcgccacttcatagtgctcttctccgacgatttcaggcgaaagcgcacgggaagtggatgcaagcggatcgaccgcaggataaatccccatttccgacagcttacgctcaaggttcgtcgtcgcatccaagtgagcgaacgtcgtagccggcgccgggtcagtatagtcatcggcaggaacgtagatcgcctgaatcgatgttacagatccgacatttgttgatgtgatccgttcctgaagctgacccatttcggtcgcaagcgtcggctgataaccaaccgctgacggcatgcgtccaagaagtgcagatacttcagatcctgcttgagtgaatcggaagatgttatcgataaagaacaatacgtcctggccttctttatcacggaaatgctcggccattgtaagtccggtcaaggcaacgcgcatccgcgcaccaggcggctcgttcatctgaccgaagaccattgccgttttgccgataacgccggaatctttcatttcatagtaaaggtcgtttccttcacgcgtacgctcgccgacacctgcgaatacagagataccgccgtgctcttgagcgatgttgttgatcagctcctgaatcaaaacggtttttccaactcccgctcctccgaaaagaccgatctttccgcctttgatatatggagcgagcaagtcgacgactttaatacccgtctctaagatttcaacctctgttgatagctgatcaaattttggagcttctctgtgaatcggatctttggcagcatcagccggaagcggctcatccaaatcgatattttccccgagtacattaaatacgcggccgagtgttacgtttccgaccggaacggagatcggctctcccaggtcgatggcttccattccgcgtgtaacaccgtcagttgaagccattgcaattgtacgaactgaatcatcacccaagtgaagcgctacttcaagggtaagatcgatgtccacttcattctcgttctgcgctttatgtgtaactttaatcgcattatatatttcaggcaagtgaccgtcttcaaaacgaacatctacgaccggccctaatacctggctaacgcgtccttttttcatctctatccctcctgacaaactttttctattctaaagcagctgcaccgccgacaatttccgtaatttcctgcgtgatggatgcctgacgggcacggttgtatgacagttcaagatcggcgataatctcttttgcattgtctgtcgcatttctcatcgccgtcattctcgcagcatgttcgctcgctttgctgtcaagaagcgcgccaaaaatcaagctttccgcatactggggaaggagcacttccagaatctcttcttcatccggttcaaactcaaatgacgtctttttcttgttaggcgcaatatctgtcaaaggcagcagctttttctccgttacctcctgggaaatcgcgctgacaaaatggttgtagaacagatacagttcatcaaaggtttcgtcaatatacatttgcaccgtgctgttcgccaaatctttgatttctgaaaacgtcacttcgtccctgatccccgtcatttcagaaatgacaggaattccgcgctttttaaagaaatcgcgccccattcttccgaccgcgatgaccgcatactcatctttggattgatggcgttcctgaatcctttgatacgctttgcggagtacgtttgcattgaacgcccccgccaagccgcggtcagctgtgatgacaaggtacccggtccgcttcactgggcggcttgacatcatcgggtgtttgccggtgtatccgactgcgatatcggcaacgacttcctgcattttttccatataaggaacaaacgatttcgctttgttttcagcccggttcagctttgaagcagaaaccatttcctgggctttcgtaatttgactcatttttttatttgaagcaatcctggatttaatatcccgtaatgaggccaaaaggtttcaccacctttttgttttcaaattccttcgcattgacgtgaaaaagagagaaaaagatagcctttttctcactttttattgtttagttgcttggcgcgaacgtacgtttaaagccttcgattgcacccttcatgtcctcatcggcaggaaggtttcctgtctgggcgattgaatcgagcagatctttatgattttggtcaagatacataaagagctcttcttcaaaacgtttgatatcctcaacaggcacatcatcaaggaagcctcttgtcagagcatagagaatcgcaacctgcttttcaacgcgaagcggtttgtgcagatcctgtttaagtacttcaaccgtacgggcaccgcgattcagcttcgcctgtgtcgctttatccaaatctgagccgaattgtgcgaatgcttcaagctcacggtatgatgccaaatcaaggcgcagcgtaccggcaactttcttcatcgctttgatttgcgcggacccgccgacacgggatacagacaatcccgggttgaccgcaggacgcacgccagagaagaacaaatcagactgcaggaagatttgtccgtcagtgatcgaaatgacgtttgtcggaatgtacgccgaaatgtcgcctgcttgcgtttcaacgaacggaagtgccgttaaagatcctccgcctttggcgtcgctcaattttgcagcgcgttcaagcaaacgggagtgaagatagaatacatccccagggaatgcttcacgaccaggaggacggcgaagaagcaaggacagttcacgatatgcggtagcctgttttgaaaggtcgtcatacacaaccagcacgtgcttgccgttgtacatgaattcctctcccatcgcaacccctgcatacggcgcgaggtacaatagaggggcaggctgtgaagcggaagccgtcacaacgatcgtatagtcaagggcgccgtgtttgcgaagcgtttcgacaacgccgcggactgtcgattctttctgaccgatcgcgacatagatacaaatcatatcctggtctttctgattcagaattgtatcgatcgcaatcgacgttttacccgtttgacggtcaccgataatcagctcacgctggccgcggccgatcggaattaaagcatcgattgatttgatccccgtttgaagcggctcgtgtacggatttacgatccataactccaggagccgggctttcgatcggacgggttttgcttgtgagaaccgggcccattccgtcaacaggctggccgagcgggttgacaacgcggccgagcagctcttcgccgacagggacttccatgatccggccggttcttttaacttcgtcaccttcacggatgtctttgtaaggtcccaaaataacgatacctacatttgattcttcaaggttctgagctaagcccagcacaccgtttgaaaattcgacaagctcacctgccatacagttatcaaggccgtgtacgcgtgcgataccgtcaccgacctgaattaccgtacctacgtcgtgaacttctatttcagactgatagttttcaatttgctgttttatgagagtgctaatttcttcagctttgatgctcacttaggtttcaccccttctttcgattttcgcctgctaattgacgttctatccggtcaagctttcctcttacactgccgtcataaatgcggttcccgatgcggattttcacaccgccgatcagatccggattcacttcgtttctgacgcgcagtgaagcggcgcctgcttcttttgcaaacacttgagaaaaagaggaaatttcctcttcgctgagcggttttacagagtatacgatcgcatcttccgtcccgcggaaccggttcgccattttgacatattcgtccgcgagatccgggacgattgacgtgcggctgcggtcaacgagaagataaagcgtatgtaagactgcagtcgaaacggatccgaacgagtcttttaaaatctgctttttcttttcagcgggcactttaggatgacccagaacggcattgaggtctttatgctcaataaatatcttcttaacgacggtcagctcttcttctatttcattgaccagcttggattcaagggcaatgtcaaacagagcggctgcgtagcgtttggagacagctgattggctcatcggctttctcctacttctttaagatagtcttggatcaatttttcctgggcttgttcgtccagctctttttcgattactttagaagcgatcatcacagacaatgatgcaacctgctcgcgcagcgcggtgacagcctggtctctttctttgacgatctcgcttctggctgattctttcatgcgttctgcttcctggcgcgcagccttgatgatttcatccttttgctgttcacccagttttttcgcgttttcaatcagagactgggattcttcgcgtgcttctttcaaaagcgcctgctgctcctcaatgagcttcttcgcttcttcattctttttctcggcagaggagatctctccggtaatgtagtcttcacgctctttcattatatttaatagcggccctaaagcgtatttcttcaagagcgctaacaaaatcagcatggcaacaagctggaacagcattgttccggcgttaaaccctactcctgcacccataacctgtggtaaaaaagacatcgaatacggcaactcccttcttgcagattatctctccgaggccatcgaaaaatgttctccctcttttttcaggagggtgattcttccggccgttatgacagttcaagcaaccataaagcaatggcgaaggcctcttgcagtgatcttcgccatttaccagttttatattcgcttttagctgaagaacgctaagaacgcgataacaacagcgataatcggaagggcctcaaccaatgctaccccgatgaacataagggttctcaattcttttccagcctcaggctgacgagcgattccttctactgtacgcgatacgataagtccgttaccaatacctgcaccaagtgcacctaatccaattgcgattgcagctgctattaaactcatgaaaaagttcctcctttaaattgttatccttagcggatatgtcttatttttagtgttcatgacttactttgtgagacatgtaaaccattgttaacatcgtgaagatgaatgcctggattgtacctacgaacaagctgaacgcctgccatacgatcatcggcacaaccgctccaatggttccaaccagccccaggaaaatgctttgagaatagaagttggttgccagtccggcaagaaggccgagcagaatttcgccggcgaaaatattaccgtaaagacgcaatcccaatgttaatgtgttcgcaaattcttcaatgattttgagcggcactaaatatggaattggtctgaagaaatctttggtatactcccccaaccctttccttttcactccgtagtaatgagtgaggcctactaccatgacggcgagggttaaagtaaccgccggatcggccgtaggggatttccaccataattcgtggcctactgttatggaaaacggaaggccgagcatgttggcaacaaatatgtacatcagcagggttatgccaagggcgagaaagtctctgccgactttaagatccattgtgctgccgataatattgcgaacaaagtcgacaatccactccataaagttctgagctttcgtcggccggatcgcgagtgttcttgtggtcagcaccgctatcagaaagacgatgatgcttgtcacagtaatcattagaatgctagttaaatcaaaattgaggcctaagaaattaacaattctagattcgtgattcaaagggttttcacctctcttccattgatgaacgttttagctggataaaggaatctatcataatgacaggataaattgtcatcaaccccacaatgacgcctgccaaatgaatatattcagggtatttataagcaatggccgccgcgataatggcgttgcacaatctggaagcagtcccgagagaacggatcattttgccctttgccactgctttatcgaaggcctgcatccttttggccagcagccagagattgaaatagctgaaaacagtgccggtaatcaggcctaaaaaaattgcctgatatggcagaaatccatagcctaacacgcagactgctaaaatatataggacatatttttgttgcctacggaatgaaagactcgcatcggtcatcaaatacgctcctgatgtgaaaattttaaatctatcttacgattacggtaaactaggcggtctgaccattttacagaacgtagtgttctgctcaagacttcacacagtccgaaaattcttgggccggtgatctgtctgtcgcctgcaaatatggggttttcaaaggattttaacagaggactggtcattatgataaccgctatgaaaaccttatcataatagcctattttagcatacaatagcccccctgaggtgtcaatctgtttaaagttaaaaaactattcataatcacagcagctctcacaaaatgttcacaaattcgcctcatttaagacgcacacatgtttaattatggtataaaacacaaaaaaagaaaaccctttttcaggattttcttacattatttcgttccgaacatgcggtctccggcgtcgcccaatccgggaacgatatatcctttttcatttagtttttcatccagagcggcaatgtaaatgtcaacgtcaggatgatgcttctgcacttcgtctacaccttccggggcagcgatcagacacataaagcggatattttttgcgccgcgttttttcaagctgttcagcgcctctaccgccgaacctccggttgccagcatcggatcgacgacgatgaattcgcgttcttcaacatcggatggaagcttgacataatactcaacaggcttcaatgtttcaggatcacggtaaagcccgacatgtccgacttttgcagcaggaatcagcttcaaaattccgtctaccattccaagccctgctctcagaatcggaacaaccccgagtttttttccggcgatgacgtttgactttgccatttgcacaggagtctctacattcacttcctccagcggcaggtctcgcgtaatctcaaatgccatcagcgttgcaacctcatcaacaagctctctgaattctttcgttccggtctttacgtcccggatgtatgtaagcttatgctgtataagagggtgatcaaacacatatacctttcccatatccgtcttcagctccttttttcacacacttctattgattctacataaaaaaacagcttgtttcaacaaaaatcaggagacaattttatgaaaaaagccgccccttttcggagcggcgcaaatatcttagtaatcaagcccggtatacaacgggaatctgtttgtcagcgcttctacacgctgttttgcttcttcaagtttcgcttcgtcttcatggtttttaagggcaagcgcaatgatcgctcccacttcttcgatcgcttccagatcaaagccgcggctcgtcacagctgctgtaccgacgcggattccgctcgtaacgaaaggtttttcaggatcataaggaatcgcgtttttgttgacggtgatgccgacttcatcaagtacattttcagccacttttccggtaatgccgagagagcgcaggtcgaccagcacaagatggttatccgttccgccggatacgagctcgataccctcttttttcaatgtttcagccaagcgcttcgcattgttgatgacattttgggcatatgttttgaattcgtcctttaaagcttcgccaaaggaaacagcctttgcagcgatcacgtgcattaacggtccgccttgaattccagggaagatcgacttgtcaatttgtttcgcaaactcttcacggcaaagaatcatgccgccgcgcggtccgcgaagcgttttatgagttgtcgtcgtcacaaagtcagcgtaaggaacaggattcgggtgaagacctgctgctacaagtccggcgatatgcgccatgtccaccatcacataggctccgacttcatcagcgatttcgcggaactttttaaaatcgatggtgcgcggatatgcgcttgctccggccacgatcagcttaggcttatgtttgagcgccttttcacggacatcttcgtaatcaatatactgcgtctctttatcaacgccgtattcaacgaagttgtactgaacaccgctgaagttgacagggctgccgtgcgttaaatgtccgccgtgagcaaggttcattcccaacacagtgtcaccgtgctccaaaatcgtgaagtataccgccatgttcgcttgtgcgccggaatgcggctgaacgttgacgtgctcggcgccgaaaatctgcttggcgcggtcgcgcgcgatatcctctgccacgtctacatgctcacaaccgccgtagtagcgtttaccaggatatccttccgcatatttattagttaaaaccgagccttgagcttccataaccgcttcgcttacaaagttttcagaagcgatcagctcaatcttcgactgttgacgtttccgctcatcttgaatggcgctaaaaacttgttcatcttgcgcaggtaaatgtttcatcagcgagatcctctcctatctgtttccatttcgttaattataccatctcattgtacacggtttttcatgcaaatgtaagagattatttttaaaattcgttttttattattggaaaaaccgaatattaaacgaatagacaaatcatatagttcgatatatcatttgtttaaaaaattattctaataaagaaaaaagcctgtccggctcttccccccgcttcttccgctactccgcttcatagacggcgcggacgcctccaatcagcttcggccttgtccgcgcaagcgtcacgtgcgcttcgcctagctgtttttgagagacgcggacaggaacggcaacaggctttaaatgcattcctataaacgtgtcgccgatgtcgatccccgcatcggcctctatttgttcaacaagaacaggagccttcatatgtttataggcatatgaagccatcgatccccccgctttcgggacaggaatggcgaaaacaacgggaagacggtatgctttcgccgtttcttcctcgacaaccaacgccctgtttaaatgttcgcagcactgaaaagcgagggcgattcctgttctgtccctgagctcttccagtcctttgtagaccgcttcagcgatttgttcgcttcccgaagtgccgatgcgccttccggccacctcgcttgtgctgcagccgatgacgacgatgtggccttcgcgcaaattcgcttgctgatgaaattcatctaatatagaacgccatgtctgttcaagatttttcatgattgacgacaccctttattcatgcttgtcttcataatcggcgatttttccgatgcggacggcgtgccgcccggctgaaaactcagtcgtaagccaaacctttgcaatctctctcgctaaaccagggccgatgacccgttcacccatcgcaagaacattcgtgtcattgtgctctcttgtcattttggcgctgaaaacgtcgtggacaagggcgcagcggatgccttttactttattggcggaaatgctcatgccgattcctgttccgcatattaaaatgcctctgtcggcttccccgttcgccactttttgcgcgaccggaaacgcataatccgggtagtccacagatcctgaaccgcattcgcagccgtaatcttcgtattcgatgttcaattcgtccatcaatgccataatttcttttctgatattgattccgccgtgatctgatgcaatgattactttcattggaatgactcctcctcgtttaatgtgccgccaaaagtctcgcagaaaccgttaagccagcatacagccgttatatacttctgattgatcatgtctattgtacccgctgccgcttgatttgcaaacgctccttagccagcttctattcctgagatttcttcgcaagcatttccgccaattttctcagcagctgctccagctcatctctcgttctttgatagtcgctgagagaaccgccgaacgggtcaataatgtccccgccatctccattaacatactctttcagcgtatagatcttatcttggctctttgaaaattcatgtactgccagctgcttgtgctgctctgtcatcgtcagaacaagatcagcccattccaccttctcctcggaaagctgtgaagatgtatgattcagagcgatgtttttttcaaaaagcgcttcgacagcatataaagaagcttttccgttttcaggagcaaacaacccggcagatttgacggagacatccagatttttttcggcagccgcagatttaaagagcgcttcggccatcgggctgcggcacgtatttccagtacagacaaataatatgttcaatcttgttcactcctttgtttcatattataaaggattcagacggaaaataataaaatccgctccagaaatcaaaaaagaggggatctccccctctttttctaagttccattatgttatgcaaaacagaaaaaagattttcccatctttcaattaaatgggcagcaaaagcttcagaccgaagctcagcaagatggctcctccgagcgcttcgctgtaggcgccgagccacgtttgaaccttttttccaagcagaaggcccgcccaagttaacaccatgctgaacaaaccgaacagaaagatcgttaatatcggtttcgttccgtagaggccgaggctgagaccgactgaaaagctgtcaaggctgacgccgacggcaaaaacgaacaagccgaagccgtgcggagagatgatctgctccccgcttttattaaaagatgcgacaatcatctgaatgcccagcaccaataaaagagctcccccaatatatcccgccagcgcaccaagcgcacccgaaagaaactgtcccgcaatcattccgccaagcggcatgatgacatggaacaatccaataatgacgccgatttgaaaaacctggttccttttcagcttggccattcccattccaagaccgactgaaaaggcatccatgccgagtgcaaaagccatcatcgaaagcgtcaggatttcgcctattaacacatcaacattcatgcaattcccccttggacacgccagcttttctagcttatgcacgtccaaaggcagatagaacacccccgcttaggctacgcttcgattacgcggtggccggccgctttcaacagccggttcataatcgcccggcccactccttcctcaggaaaagactccgcaaaaataaaatcgagacgttcttcatcaaagctgcggagaacgtcatacaaaccggcggcaaccgtttcaagtcggtctcttctgccgcagatgcggacggcatcggcctgatagacatcggcccgttcctctgtcgtaaggacaccgactttcatcccgtctttctgatattggtcgatcagccgttgaatatcctcaactcccccgttcacaatagcaagaggtgcttccggtgcataatgcgtatatttcatcccgggagacataggcgcctttttttcgtcggtgaggccctggtcaatcaagacggggccggccgcttcttcgagctgctcttttgtgacgccgcccggcctcaaaatgaccggaatttcaccggtgcatgaaacaactgttgattcaacccctactcctgtagggccgccgtcaacgacacccgcaatccgtccattcaaatcgttgacgacatgctcggctttcgtcggactcggttttccggacagatttgcgctcggggcagccaccggaacgccggcctgtctaatcagctcaagcgccacaggatgatcaggcattctaaccgcgaccgtgtcgagccccgccgtcacccttgtggataacaccccgggcttgcacggcagcacaagggtcagcggcccgggccaaaaacgcttcatcagcatttcggcctgaggcgaatcaacttccgcaaattctgcaagctgttcaatttcagcgatgtggacaatgagcggattgtcgctcggccgccctttcgcttcgtatattttagctactgcttcgctgtgtttggcgtttgcaccaagaccgtaaacagtctctgtcggaaaagcaaccgtttcattttgctgaagcagtcttgccgcctgtgcaatttgtggacagtttgtggacaaatcgcgttttacatccacagtccatacttttgttttcattaacatcaaaactcccttaacaaaacactaaaaacgttaataattcatgtaaatcatgttgaaagtataaaagatgaaagaaaagaaaacaagcgttgtccacattttgtggataacgcttttgaatccgtggatatctctgtgtataagttaacggctaatttgacgttttctccattaaaaccgctccgtttacgttcagtgagtctgaaacatgctcggattcatccagctcatcaggaattgccgcagcttgtttaaaaccgagcacttcaaggaaatccatcgatgttcgcttattggctactaaataaagggtttggattcctcgcttttcgcacaatacctgcatgctttgaaacaaggaaacgatgtggccttggctgagcttgtcagacacgacaagcgagcgcagcagtccttttttgttttcaaattcctccattccgaggcaggcgacgatttcatcgggagggtcttccatcatgataaactggctcttcgcttcctcaagacccttatggcttgtccccgccttttttaaaaatgcttcgatcgcattcatgtctttcgtttccgctaacctcaattggtagaacatcttttcaccccgttttttaacttctctatccaatctatgagggcgacagtaaaatataccttttgatttggaagaatgccggctattcatttttcaattttgattagcaggaaccaacgctttgaatgagtatgcaaatgaacgctgtactggtgataagacagtttctcttctgccggcaatgtgattggcacatcagaaaggggcaaaaggtgtatatccgaaaagcagtatttcccctgaaccgttttggaaaattatatcatattcaaaagcttcaataaccatcatgaaaaaacaaacagtaaaaaaccgccctgcacacgaaagcaaggcggtccttttaagaaaaaagcccggtaatccattcgacaagaaaaaatttcacttctttgtcttctttatctttatctatgccagataccgtttcatccgccgcgtctgttttttcttcccggcggtcttctccggcagcggtttgttcgtcttcaggcgactttacggcttccccattggaaaaatcaagaaagcaaagtggcggaaacaggacgcaccaccagttggctccctctcccttgcctaatgtaattaaaacagcctcatattctccggccggatacaccatattgccgtatagctttgtcggaaatgaaacacgatcaaaacggacagacacggattgccgaacattttcgcgtttcatgacatccatggcaacctcttggatttcaggcagcttcgacctgatgacttgtctcgcttcctcaaccgaggtcaggttttccacccatttcgtaatttgtttattgacctcatccctgattttgcgtttgacgctctggtcgctcccgctgtcgctgtttgccaaaatccgcagccgaatcgcttcatcaggaatcacggcaggctgcccgcctgatgattgggcagtctcttccgtcgtgagatttgcaagcgctcctattaataaaagaaaaatatacatacaggcaatgtttgatttcttcattttccccaccgttcctctcgttcttcaaccttttctagcaatattatggtcaaagatggaacggtttaaacggctgctgaaaaaaatcctactaagcttgtaatctcttcctaataaatctacatatccaaatgactctgcttgtttttttgcaggccggataaaaaaatcaccgcgctgatcgccagcagcaagccccccaatccgccgaacagcaaaaacgggaagacagcggctgcgcttgcatcaatcgcccagccgatcaagaatgaaagaagcgctcctcccagacttgcggacgaaatgaagagactcgtgatttcctctgtaaaaggctttccagccaacgaggcaagagtgacggcgcacggaaaaatgccggctgccgacagcccgatgaaaaatacgaggagcagctgtgtttgatgaaccggaaaccacgcgagaatcaaaagcaaaacagtcaaggctccggcgctgaagatcagaaaggcaacggaagttatgcgtccgccaaaaatacttgtcaataaacgtccgcataccatccccgtccaaaaaaacgtgacgctgatcacgctgatttcttcagcccctttttccagcatcagcgccggcaaaaagtttgcgaaattggtctcgatacccgcatacacaaaagcgaatatgagaaagaggaaaatgtttttttctttccttccggtttcaaatatggctgatacagtcggtttttcctgataagccatctgaccggaagcagtgccgggggtttttctgcgcaaataaaccccccacatacacgcgagcacaaaaacgaagataaataaagcatacaaggggaaatgccaggcatatcgttccgtaaggatataaataagaaaaggaaacagcagcgcgcctaatccgaaaaaaacctctaaaatattcatccctttcgcatttttatcttgcgcaatcacatacgcccccatcgtcgtttctaaagtacccgcgccaaagccgagcaaaaatcccatgatgacaaaaaagatgaacatatcaaaaaggaaaacacctaaaagcgtaacgagaataagaagaaggccaaacgtcaatacagccgtatgagaggtgcgtctgacaaacatcggcgcaagcaggacgccgtttagaaaaccggtgaattggaaaaagatcaggaaggatagatcatgaagatcccgttgatattcttgaatgatgtacggtgacaggctccccagcagaatatggataacccctactagaaaataaaacgaacagccgaatagaaatatttttttcattagactcactccttcgttgcagaccataaaacccttgcggcttgggtggcacagccggcaagggtctttcgcaatgctagtttgcttgttttgaaagggacagctgctgacctttattgaaaaattcatttaagtagaactgcgtcttgtatccatcttcaaaagtggcaagagatgcaaaattgcgatcccgaattccgttcatccattggatcagctgaactctgaaggaatcggcccatccgtaaaattcattttcagggtctgtcagccacgtgtccggcattgttatcatctgctccgtcaatccggccctcagcaaaaactgatttttctgccgtgaatgatagtaaaatacgccgttttggccgttgacctcgatgctgaagccgcactcatccgattttgtgcattttgacgtaatcatattgacaaacacatgattttcaagctggccgtatacttctgaatgatcatcaacatatacctgtttttgttctttttctttgacgaccgtcatcattttgacttttaaactgtccagtttaaacgggctgtcgaacaaatagagtatgagatcgattaaatgcacgcccaaatctcctaatgccccgctcgttttgttgcttttcgaatgatcgcgccaagtatatttttttcttctcaaggcgctgtttttcttaaaatggacattgatggacaaaatatctccaagttcattgccggatatcatatcttttaggcgcttaacgaatgtgagatggcggtaattgaagcccatgatcggaatataagcggattgagacgccctgcttttcatctcctccgcttcttccattgagacagccatcggtttttcacacaatacatacttccctgcagccatcgcttcaagcgcatgttctttatggcaaaagttcggcgatgaaacgatgactgccgtcgactgattcaacagctcctgcatactggtaaaggcagttcctccgtattcaaacgcacatttacgagaggcaagcgagttgatatcaaaaaacccggaaagctcggcacctttgactgttgaaagagctttcgcatgggcttttgcaattcctccggctcctataattccgattttcatctaaggacactccttatcgtttgatatgggcttttagcacttctaaaattccagccgtatagctgccttctgtcatacgggaatggagcgacttggcttctgctgtcgcattccccaccagataaccatgtccggttttttttagcatatccacatcgtttccgctgtcgccgaaagcaaatgaattctccctctctatcgcgaatttatccaatataaaatccacaatgtacggtttgcctgtccgcaaggggataaagtccacatcatagctgttttccggatcgcctgccaaagggttgcagcgattgatatttactcctattccatgctctcttgcaagccgcctgatggcttcaagcgccctcttatctgtgctctcttccaacgatttatagtaatagttgattttatagcgggaaaagccatgctgagtctgaggcacaagcgcaatctcatattttttagagagagtctgcttgatttcttcgaccagatcatgggagaaatttgattcttgcaatcgggcttcccaatctttatcagagacttggccttcttcagagaaataagtgatttcagtgccaaggtcaccggcgacaaaatgcggaagatatcgaaagcctccccgcttcatttttgcaagaacggatgacaggctgctcccggtcacccagccgagcaaaatcttgtgatcaagatggtgcgaatgaataaatgtttcaaggtccatgagcgcttttctcgattcatcggtgatgctgtgggcgaaatatgtctcatcaaaatcgcaaaatacggcgtacttcggcttgtttacttgctgcaaggtgtgaaaagaaagtgtttcatgatacgacatcaattaaggcctccattactttgtcttgttcttctacggtgagccccggatagagaggaagctgaagcatttgtttatgcactgattcagtgaccggcagtgatgtgtgccgataattggcttttacaagtggtgtgttttgatgatgggataaaatcgggtagtatatatctgtttggacattatgaaatttaagcatcatatctttgacttggtcacgatttccgtttagtattttaattgtaaacaaatgccatacatgatcatcggtcatttgaggcaatttgatcagacctctgtcttcatactgctgcaaatgcgcaatataacgatctgctaaatataagcgcttcagattatttaaagaaagatatttcatccttgccagtccaatagcggcttgcagattatcaatcttagcgttaaagccgtagtcagccgcctttttatttttttgattcagttcaaagccgtgatacatatattccatgcatgcggatgcaaatgatggatcatccgtcacaattgcgccggcttttccgcaagtgccgagatttttatacggattgaagcttaatatggagcaaaggctgttttttcccagatcggaaacgccgatcgcctggcaggcgtcttcaataatcgggatgccgtatttatcagcggtttttgcaatggcttccatgtcaggcagctttccataaaggtgtacaggcaaaatgcatttcgttttcaaagtgacacatgcttcaatttctgaaggatccatgcaaaatgtaacagggtcaatatcgcagaaaatcggagtgcctccagctgcgagcacggcgttttccgttgcagcaaagctgtttgcaggcataatgacttcatcaccttgtccaacacccgcagccttcagcgcgacaatcatggcatcggttccgctggatgaagccatgacatgctttttgctcaaaaaagcagctatttcagcttcaaatacgccaacataaaaaccgcttgtaaattgcccggtcggcagcacgtctttcaccgcatgaaccacgtcatctacttcttcttctgtgatcagtcgatgaagcggcataaagtcaactctggagggcggggaatccattctgttcagcaaattggcggttatgtcgaattgatcctgctgcaatgtctcttttaatttttgattggccagtgtgtcgtctatacggcattcaccagcgagctttccttccttcaaatcattcagaaggacaaatagctgtttgctcgtgcaagtcatgttttcgtttgcggttttcatcaatttcaccccatttttattattttgggaaattgtcatatttcatgacatatcttaaatgatggaatcgataccataacaactctttttttcaggaagtgactttatgcctacgattgacgaaattgcaaaattaagtaatgtgtcaaaaacaactgtttcaagagtactgaacgatcatccctatgtatctgaagaaaaaaggaagcgggttttggaagtcatcgaaaaattggactacatcccgaacacgtctgcacgaaagctcagatccaacaaaacgatgtttctcgcagtgtctgtcccacacgcggaccaccccttcttcgctcagcttatgaagcatatgtccgctgaagcgctgaaacaccaatacaaagtcattgtgtttcagacgttttatcaaaagcagaatgaactgaaagtactggagctgctcaagaggaaagaagtcgacggcgttatgctatgcagccttgaaaatgaatgggaagacatcaaaaaatacgtcaaatacggtcccgtggttatggcaaatgaattccacgccgaagcggacgtgccggtgatctgctatgacgaattcgaagccggatataaaggaacggagctttttattcaaaaagggcatcatttaatggccttttgctgtgacacgatacacagcaaggcccagattatgagaaaagaagggtttatgaaagcattgtctgatgcaggtttgcgtttccaggagaagtggatgttcagccacgcatttaccattcatgacggcttccgcattatggaccagatccacaacatgtccgaaaagccgaccgccatttttacgggaaacgaccaagtggccgcaggaattattaaaagggcccgatattatcaatatgaagtgccaaagcagcttgcagtgcttggatatgacaatcaatcgatctgtgaggtgaccgatccggaaatcacgacaatcgatatacctgttgaagagctggctcaaaaagccgtatgtgcaatggtaaaccttctgaatggggaaagcggcttacagagggatgtcgtgacactgtcccctgcattaaaaataagacaatctgtttagtatatatattaatcttgaactattttttattttattcagataaaaattttgttaaaaaatggtaaagcacgccgccagaacggtcaaggctgcggttcctattttccaccgggaatttgagccgccccccttttgttcgacacacttaacaattggaggcgcagttttctaatggctaaatttacagctgaggaactaaagggtaatttgcggggaatgaagggcataaacggatcaagatcaaatgaaaaggcatgagcctggtacaataccggaatcatgccagttaaactgtttcatgacattttattgtctaacttttggagtcacttttaactatgttgttcaattaccgcgcagacgatgcggtcttttccattaagatctttcttcacccgcacgtcagcatcaggaaagaaccggtgaaacatgtctttaacggcattcccctgagtccagccgatttcaaacaccaccagtgcctgatctgcgatgacagatggaatttccttcatgaaacgcttataaaactgcaatccgtcagcaccgtccgttaaagccccggcgggttcatggagacggacgacatctgacagcgtcctcatgtcttcctcggatatataaggtggattcgaaacgatgacatcagctttcttctgtcgcgcgataagcggttcaagcaaatcaccgcagaggaaatccactttcgccccaagccggtcagcgttgtgtcttgcggtacttaaagcttgttccgaaatatccgtcgccgtgacggaaaaacgcgggctctcaagcgcaagggtcactgcaatcgccccgcttcctgtaccgacatcgacagctttaagacgatctgtcccgtgaaaaactctttccgcttcggaaaggacagcttcaacgacttcctctgtttcaggacgcggaatcagaacgtgttcatttaccgaaaattcccttccgtaaaaggactcttttccggtgatatattgaacaggcactccttgatgatgaagctcgacagattttttaaacctcgcaaaatcagactctgatatgacatcatggaagcttgccaacagtttgctgcggtcgatgttcagctgatctgtcagcaaaatttccgcggcattccggtctcttcccgcttccgtcaaataagaagaagcccacctgagggcttcaaaaattgttttcatgtttagctctccgcctgctgaagcttgcttgcctgatcctctacaatcagggcgtcaatcacttcatcaagcttgccttcaaggatttggtcgagcttttggatcgtcaagccgatcctgtgatcggtaacgcggttttgcggaaagttatacgtgcggatgcgctcagagcggtctcctgttccgacggcggatttccggttttgatcatattcagcctgagcttcctgctgaaatttgtcgtaaattcgcgcgcgcagaaccttcatcgctttttctttgtttttgatctgagatttctcatcctggcaagacacgacaacacctgtcggaaggtgggtcagacggacggctgacatcgtcgtattgacgctttgccctcccggaccgctcgatgcgaaggtgtcgacgcgaatgtctttttcatgtatatcgacttctacctcttccgcttcaggcaggcaggctaccgttgccgtggatgtatggatgcgcccgccggattcggtctctggaacgcgctgtacgcggtgtgcgccgttctcatacttcagccttgagtatgcgccgttcccattgatcataaaaatgatctctttatatccgcctgtacctgtcatattcgcttccatcacttctgttttccagccttggagctctgcgtagcggctgtacatgcggtaaaggttgccggcaaataaagcggcctcttctccgcccgctgcgccgcggatttccatgataacgtttttgtcatcattcggatctttagggatcagcaataccttcagctgatctgtgagcgactcgatttcttcctgcagttcggaaatctcctctttcaccatctcgcgcatgtcggagtcaagcttttcttcaagcatcgctttagcatcgctcagctgttccgacgcgctacgataacgtctgtatacttcaactgtttcctgtaaatcagattgttctttcgaatattctctaagcttcttcggatcgttgacaacctccggatcgcttaatagttcatttaatttttcgtaccggtcctctatcgattttaaacggtctaacacgctattcacctctgtttgctgtgcgtaacattctaattatagtatagggactcttccccgtcaaaacaacttcgccgttatcggcagcagccgcgtctttttgctatacttttaagaaaaaaggagcttgactcaatgctggaatcgattcatcacatcgccatcatatgctcggattatgaagcatccaaaacattctatgccgacaagctcggacttgagattctgagcgaaacgtacagaaaggatcgggaatcatataaactggacctctcattaaacggccgctatgtcatcgaactgttttcttttccggatccgcccgcacgccttaccagacccgaagctgccggactccgccatttggctttcacggtggccgatcttgaccagaccgtcaaggagctcaagcaaaaaggcatcactgctgaaccgatccgcaccgatcccgggacgggcaagcgctatacgttcttctccgacccggacggcctgcctttagagctttacgaagcatagcaacggctgcaccctctggggaaaaaccgctttctttgccgaatcccttcttcttttgtctaacaggaaggaggccttttcattcaggtcgaataccctttttaatgaacagttacaggttaaaaggaggtatcttatgaatactgctgatgcggcaaatgaactgggggtttcaaccaaaacggtgcagcgttgggtcaagcagctgcaactgcccgcttcccgaaatgagcttggccactactttttcacggaagacgatatcgccattttaaaagaagtaaaagagcagttgaaaaacggtacgcctatgcaggatgtcacggtcaaacgcccgaaaaaaaccttcttcatcaagaaaaacgaaatgattcaaacgaaagagcctgcactgcaattgaatgagcggctcgaagaaaggctgcagcgttttttagagcatgaacagcttgaacgcgagctgctccaaaagaaaatcgccgagctggaaagaaagctggagcaaaaagcggacgatgtcgtctcctaccagcttctgcagcaaaggcgcgaacttgaagaagaacggcagcagatcaagcatctcgagcagaaaatcagccaattggaaagcatgaaccgccgggaaaaagatacagccgtcagaagagaagaaaaaaaaccgaagagcaaattgaaatcgatcttctctttttaaagcgcaaaaaagcttgcaaggccataaacggcttcttgcaagcttttttcttacttaagctgtaattgcaatcaatatcggcagcgaaataatcgacagcaccgcactgatcacaaacgcggatgccgtttccgcttcctggctttcaaagtttgtagcaatcatggccgccacagcagaaccagggaatgccacgagcagaaccgcttttgtcatgtcggcagaagaaaggccgacgaccatcgcgatcacaaacattaaagcaggctgagcagcgacttttaataaagcgatgctcaaggcaggcatactgaatttaattttgcggattccgacagtcaccccgactgcgaatagggcgattcctgaagtcgtatctccgagcatatcaagcattttctgcggcaattcaggaatttgcagaccgaataacacaagaatgatacttgcaagcggtgcaaaagcaagcggttcagacaaaccgtgtaaaattgattttcctgtcaccttccaaatgctgtccgtcgtttccgtttgtttttttgaagaacggccgacggttccgacgatgatcgcaagaggatcaagcatcgcatttacgacaattcccgtaatcgcgattggaatcgcaacttcctgcatgccgaacaggctgcccaatacaggaatacccataaaggcgaatgtcggctgtgctgagttcaatgagaacattgaagcatctgttaaatcgtatttaaacaaaaatcgtaaaagaagcaaaataataacgtaaaatccaacgataccgattaccaatgaaatcataagcggaatctggctgtaaaacttatcttttggcgttgacaaaatgcttgatacaaagtgggccggaagcgcgtatttcgttacgagcgtacttaccccttttgctgatttagcatcatagcttccaaagtgacccgcaaaccatcccagcgcaataacaaaaaatattggcgcaaggaggattaaaatatttaaaaagctcaaggctgtttcctcctctatgttgtccctttcagggacgtattaacggcggctgataaacgcggtcgccctgttacacagccgccgaccccattttttttaaatttgattggtgcagcccggtgacaaaacatccgcacccgggctgccgtttcttttatcgtttcctcagaacctaatattagtcttgttttgcaacaattgttttatactccggacgccacatggcttcgcggacagccttttcgacatcttcaggctgaacttgggccacgccgtctttaatggcagcttttacaacgtcgatcgccacttgaacggatacgtcttgcaggtcgtcgattttcggcagaagacctgcacccggcttttcatgatccaccatgttcgcgaccgcgttggcagatgcagcaaacatgccgtttgtgatgactttcgctttcgcaacgattgtacccaggcctaatccagggaatacaaaagcgttattggattgtccgatttcgtgtttcacgccattgtactcaacagcttcaaacgggcttcccgtcgccacaagcgcttttccgtccgtccatttgaacaagtcttcaggaacagcttcggccagatgtgtcggatttgacatcggcagaatcacaggacgctcagtatgagccgccatctctttgatgatttcttcactaaaggcgccggcaacacctgatgtaccaatcaggatcgtaggcttcacttgacggatgacttcctcaaaggaaatctctcccttttcattgcgtttccaatctttcacttcttccgtatcgcgcaaatacggttcttggaaatccatgatttgatccatgcctgtcgttaataatcctctgtaatcgactgtccagaatgcacggttggcttcttcttctgaaagcccttcaagcaccatggtgtcgcggatttggtcagcgattcctataccagcagaaccaggtccgaagatgacgacccggtggtctttcaaagacgtgccggtctttttgacagctgctaaaatcgcagccagcgtgatagcccctgttccttgaatatcatcattaaatgttgcaattttatggttatatttactcatgatattgcgggcatttttatttccgaaatcttcccagtgtagaagcgcgttagggaaaagcttcaatgctgtttcgacataagcgtcgataaattgttcatagcgctcgccttctacacgcggatgacggtttccgatatagagcggatcgtttagcagtttttcattattcgttccgacatccagtacgaccgggataacgcggctcggatcgattcccgctgccgccgtatatactgcaagcttaccaatcgcaatattgatgcctccgacgccccagtcgccgatccccaaaatgctttcggaatctgtagcgacgatcaaatcgatgtcatcagcagacgcctgcaggtttttaaaagccgtttcgattccgtccatatcatcgattgacaagtaaacgccgtgcggtctgcggtattcgtggctgtattcctgaatcgcttcgccgacagtaggcgtatagacaaccggaagcatttcacgcaggtggttttgcaataatttatagaaaagcacttcgtttctgttttgcagatcgttcaaatatacgttttggcgaagtctgtcaggttgacgggaaaattgttcgtaagcccgttccgcctgctgatcaaggctgagaacagtcggcggcagaagcccttctagaccgaggttctttctttcttcaagagaaaatgcaacacctttatttagcgttggaatggaaagaacgtctttaccccgcaaagaagtctccaaatgtccttccttcgttcttctcatgttgttcacactaattaccttctttcttaaaatgttaatgaagtgaaataaatacggtaaacaatatagaatatttgcctttttacacatgtagatttgtcaaatatgtaacgcgcgttttttgacaaaaaactgaacatttcctaaaacctatttactttttactgactacagtaagtcattttatgcctgcttttgtcaaaattcaagcgatgaaaattagttaattttttcgtattcttaattaagttttttaattacattaattcccgcaaaaaggattcaataaaaaaaacacttgtttttaccaagtgttttcgagtgaaaatctatatgtttttccgatttcatttcggctttccaggcacttcatggtggtggcggcagcgcgcttcatatgcttcggaggcccccaccaaaatgaccggatcgtcataagaagcaggttttccattgatcagcctctgcgtgcggctggctggggatccgcagacagagcacacggcttgcagcttggtcaccgtttccgctaaagccatcagatcgggcacgacgccgaaaggctcgccccggaaatccaaatcaaggcctgctgcaatcacacggtagccctgatcagccagagaagttaacgtgccgacaatcgtttcgtcaaaaaactgcacttcatcgacgccgatgacatccgtttctttgcttatgtattgaaaaatttcttccggagatgcgatggcatggcacacaatggatgtcccattatgcgatacaaccgattcgctgctgtagcgattatcaatggctggtttaaacactttgacttcctgcttcgcaaacgtcgcccttttgatccggcggatgagctcctctgatttgcccgaaaacatgcttccgcatatgagttcaagccagccgctttgcttcatgatgtacatccaactaactcctctccagcaattattgcaagtaaaaaacaggcaagaagaatccctgcctgtttatcatatctattattacttaagaccgtattttttgttaaagcgatcaacacgaccatcagcagaagcgaatttttggcggccagtgtagaacggatggcattcagaacaaatctcaacgcgtacctcttcttttactgaacctgtttcaaattcgtttccacaagcgcatttgactgttgcttttttgaactcaggatgaattcctgctttcatgtctgtcatctccttccgccctgaatccaattcggaaacagagttattattccggggcaaaacctccggaacgcacatgatagaattataacagcgattcggacgttttgcaaactaaagttttaaatcagcgccttgcagcagacatattggcttgtttccattcctggatcagaatatcgaaaaactcctgattcgttttcgtctttttcatttttctcatgaatttctcgacgaagtcaggcgtgtcagacatcgttttccggattgaccacagacgatcaaggtgctctttcggaacgagaagctcttctttacgcgtacccgaacggcgaatatcaatggcaggaaagattcttctttccgcaagagaacggtcaagatgaagctccatgttccctgttcctttaaattcctcatagatgacgtcatccatccgcgagcccgtgtcgacgagagcggtcgccaggatcgttaagctgccgccctcttcaatgttgcgggctgctccaaagaaacgctttggacggtggaaagcgccgggatcgattcccccggacaatgttctgccgctcggcggaatgacaaggttataggcgcgggcaagccttgtaatgctgtccattaaaatgataacgtcctttttatgctcaacaagcctcattgcacgttccaatacaagctcggccaccttgatatggttttcaggaacttcgtcaaacgttgagctgacaacgtctcctgcaaccgaacgttcgatgtcggtcacttcctcaggtctttcatcgataagaagcacgatcagctccgcttccggatgattggttgtgatgctgttcgcgatctctttcaagagcatggttttacccgctttaggcggagcgacgatcagaccgcgctgtccaaagccgaccggcgccatcatgtccatgatccgtgttgacaggtgattcggcttcgtttcaagcaccatctggcgatctggataaagaggcgttaatgccggaaagtgcacgcgttcttttgctgattcaggatcgtcgccgttaaccgcttcaacgtgcagcaggccgtaataccgttcgttttcttttggagggcggacctttccggacactttatcaccgtttctcaaatcaaaacggcggatttgtgaggcggaaatatagatatcctctgaactaggcgagtagttgatcggtctgagaaagccgaacccttcggactggatgatttccaatacgccttccatgaacagcagatcttcctgttcggcgtttgctttcagaatggcaaaaatcagttccttttttgtcagtttgctgtaataagagactttataatgccttgcaagctcatacagctcttttaatttcatattttccaaagatgaaatggatacatctttcactaagaacaccactcttttctaatcgaataatttactttgtctcatcaatttcacgaaagacgattaatgtatactgccgattcgttttaccggcaacgcttctacccatatatatcgacgtattgaaaaggattataagtatgagtcgagaaagaagcgaggacttaacaagagaagataatcgcatatctgatagatgcggcaggattttggttctctctaggaaccagcatgtgcagaaaatttcgcagcactctttagttttacctcatttgtcgtacatattcaacttcatttatgatttgacatgaaattgatagagatgaccctgttttgaaaaatgccttgacatgaagaagaaaagccgttagctattgtatcagagtatgaaccttgattcaattcgtgaagtgaaatacaagggaaaagcgggtcgtttatatccccgcttttccttttccttatggccggatgactaggttaggttttttcttgagactgtgtcttccgtccacaaaccgtaccgtaccggattttgccctcatgactacgctgtgggtcgttccaacagatcctttgaattgcacgcctttcaggagctctccgtctgtgacgccagttgcggcgaaaatcgcatcgtctcctttgacgaggtcttccatgcggagcactttgcccgtatcaagccccatcttttcacagcgtctcagttcttcctcactttgaggaagaagctttccgtgaatttcccctccgagagctttgagtgcaacagccgagagtacgccttccggagcgcctcctgagccgaataaaatatcgacgcctgtatgatcaaaagcggtgttaatcgcaccggccacgtccccgtcattgatcagcttgattctggcgcctgcttcgcgaagctcatggatgattttctcatgccgcggacggttcaaaatcgtggctacaacatcttccacatctttattctttgcttttgccacagctttcaagttatcaatcacaggcgcttcaatatcgatgcagcctacagcttcaggacctacagcgattttatccatatacatgtcaggcgcattcagcaggtttccgtgatcagccaccgcaatgactgcgagagcgttccatccgccgctagcgacgatgttcgtcccttcgagagggtctactgctacgtctactcgagggccgtagccgttgccgagcttttctccaatataaagcatcggcgcttcgtccatttccccttctccgattaccaccgttcccttcataggaatggtgtcaaacacatccctcatggcgcttgtcgcagcgtcgtcggcttcgtcttttttacctcttcccatccagcgcgctgactttagcgcagccgcttctgtcacacgaacaagttccatcgataagcttctttccattcctatctaatctcctctcacccatatgaaatcgttttatgttttatctataacagcatttgtcgatcacgagttttgcagctgttcaatttcctggtctgtcaatttttcgcgccagacagtggccccgagctttgtcagcttttcttcaagctgactgtagcctctgtcaaggtgctccaaaccggtgatttccgtgacaccttccgccattagaccggcaacaacgagacatgctcccgcccgaagatcactcgctttcaccttggcgccctgcaaaggagctggcccggtaatgatcgccgatcttccttcaaccttcatcgacgcacccatgcgtctcagctcgtcaatatgtttgaagcgagcggagtaaatggtgtcagtgacaacgctcgtcccgtttgccttcgttaaaagcgatgtcatcggctgctgcagatcggtcggaaagccggggtatacgagcgttttcaaatcgaccggtttcagctctttctgtccgccgaccattaaaatctgctcgctgctttcttcgattcgaacccccatttcgcggagcttggcgattaacgattccaaatgcgtcggaattacattatcaatcagcacttcttgtcccatggaagcagctgcaatcatgaaagtgccggcttcgatccggtccggaataatcgagtgtctgcacccgtgaagcgattcaacgccttcgatgcggatgacgtccgtaccggcgccttttatttttgctcccatgcttgttaaaagagtggcaacatcgataatctcaggttctttcgcagcgttttcaattacggttctgcctttggcaagcacggcggcaagcatgatgttgatcgttgctccaacactgacgacatcaagataaatgcgcgcgccttttaattcctccgcacgcagatagatcgcaccctgttcgtttgtcacttcggctccgagcgcctcaaaacctttgatatgctgatcaatcggtctcggaccaaggtggcagccgcctggaaggccgatgaccgctttcttaaagcgtcctagcatcgcgcccattaagtaataagaagcccgaagctgtttcacttttccattcggcaaaggcatgctgatcatcggcgcaggatcaacgaccatttctcccttttcaaagtgaacgtttccgccgatctctctcagcagatcgcgaagcgtcaaaatgtctgaaatatggggaaggccttcaagcgtaaccgtcgaatcagccaaaatcgtcgcaggtatgagagcgacagcgctgtttttcgctccgcttatatgtactgtgccattgagaggatcgccgccagctatatttaacttttccatgatcgtctccttccttaaagaagatagctaatggagcgcttcataatgagatttccttcaaactcaaaataaatggttcatttcaaaatctatccaattaaaagagaaagaatacaacacatttcaaatttatcgggaagaaaagtagcgaagcagactgcggcaaggttctcttctgcaaaacattcatttctctttgtaagacaaaatggtgacaaacggagggagcccctccacttgccacccacatgaagcaattatttattccagtcagccaaaaactgttcgatccctttatcagtaagcgggtgctttgtaagctggtgaatgactttgagaggcatcgtgccgatatgagctcccctgagcgcggcctcagtcacatgctgcgcatggcggatggacgcggcgatgatttgcgtgtccaaaccgtgcacatcgaaaatttgtttaatttcactgatcaagtcgaggccgttgtggccgatatcgtcaaggcgtcccaggaacggggaaacatacgtagctcctgctcttgcggcaagaagcgcctgatttgcgctgaagatcagtgtgacgttcgttttaattccgagatcggttaatgctttaacagctttcaggccgtcaggcgtcatcggaattttcaccgtaatattcggcgcgattttcgcaagctcttttccttcttcaatcatctcttcagccttcagagaaataacctcggcgctgactgacccagaaaccacttcggtaatttcacgcagacggtcatgaaacgaaatgttttcttttgctactaaactaggatttgtcgtaactcccgcaagcacgccgagagcgtgcgcctctttaatttcgtctaaatttgcagtatcaataaaaaacagcatattgataaaacctcctgtcatgaaaatgtctgaactgtggaacttgtttgcgctttccggatgatatggataaaaccgcctgtcgctatcaggcggcttttttgactgaacgggaagcaaaagagcctcatgccgtcacatggcatgtgttaacagcacttccctctaaaacaccagaaaaacatcctgtttccccggctttgcgggaaaacagatgcttttccaatcgtcattatgctttgtttgaagaaccaaattcgcgcattttgccgataactgtttctttgatagcttcgcgtgcaggtccgaggtatttgcgcggatcatactcttcaggcttcgcagccagcgtttcgcgaacagctttcgcggaagcgatttggttttcagtgttgacgttgatttttgccgtacctaaagaaatagctttcttaatgtcggcagtcggaatgcctgtaccgccgtgaagtacgagcggaagaccagttgtatttccgatttcttccatttctttaaatccaaggtttggttcgcctttgtaaggaccgtgaacagaacctaatgcaggagcaaggcagtcgattcctgtgcgctcaacaagctcttggcactctttaggatccgcgtagatgacgccatctgcaattacgtcgtcttcctgtccgcctacagttccaagctcagcttcaactgatacgccgtggaaatgagcgagctcaacaacttttgaagtcgtcgcaacgttttcctcgaaaggatggtgagaagcgtcgatcataacggaagtgaatcccgcatgaatcgcttttgcacaagattcaaagcttgaaccgtggtctaagtgaatcgcaacaggcactgttacgttgtattcttccatcagcgctttaaccattgcaacaacggttttaaaaccgcccatatagcgtcccgcaccttctgatacaccgaggataacaggagatttctcttcttcagcggcttgtaaaatcgcttgagtgaactcaaggttatttaagttaaattgtccgacagcatatccgttttcttttgctttattcaacatttccgtcattgatactaaaggcatgtcgaaagtcctccttatgtagcctgaattgcttttgcgaaaaaagcctccacacctacctagcatgaccagaaaaatccgccatatgtaaaatgttttgttttttaaaaaacgttagacagcttttctctacttatatagaataacaattaatcaacaaatcggcaacattgtgactgtgacaacatcaaaaacttttccgctatccgttggactttatgggcagatacgttttgacggcatcgcggatttcgtcgatgtcaaaaggcttagcaaagtgtgtcagggctccgagctccttcgattcctggatcatgtcgagctctccgtaggccgtcatgatgatgacgcggatcccctcgtctatgatcttcattctttttaaaatttcaattccgtccattccggggattttcatatcgagcagaacgaggtcggggcgctggtttttcacaatgtcaagcgcttgaatcccgtttgcggcctggaaggttttgtacccttctttattgaaaacttcattcagcagaacccgaatcccgtactggtcgtctacgattaaaatcttctcattcatgatttacacctctatatttataattttcgccaaaattaagcagtagtttatctattctgttttgtttttctcttttcctttaattaaaatatttaagtttgcgacatatttagaggatttttcccattattctcttttgttatataatgatagtcagtaaaaaaggaggagtcaccttgcttaaaattttcaccactcaattgacgggaatcttcaaccggattcaagagggcgaggcccaatcgatagaggacggcgcccgcttgttggctcaggcggtcatcagtgatcattcggtttatgtatacggaaaaaatgaattggaaggcattttgaaagaagcgatgtacagttctgaaccgttcccctcagtcaaaccgctgcagaaggacgaagaaaactggcccgattttgaaatgacggacaaagtgctgatgttctgcgccggttcagcggatgacgaagaactgaaaatggcggaaaaactgtatgaaaaaggaatcggacttgttgtcgtctccccttcgggaaaagacggcgtcccgatcgcatccttcgccgatgtccatatcgattcaaagctgagaatgccgcttcttcccgatgaagacggaacaaggtacggatttccgtccctgatggtcagcctctatatttatcatgccctatcctttacattaaaggaaatcctccaggaataccaataaaacagggttgcctaaaggaaattagtgacgtgaggccggcctaatgaatatagtaccagttcgggccgccattatcatcagaaagagcccaaaaaagcccgccggcgtgatttgccggcaggctttttcttttttacagcttttccgaagtctttagcgaagcatgtacgaagtctctgaacagagcctgaggtcttgtcggtcttgacgtaaattcaggatggaactgagacgcgacaaaccatggatggtctttaagctcgataatttctacgagacggccgtcagggcttgtcccggaaaatacaaaaccggcttcttccatctgctgtctgaactcattgttgaattcgtagcggtggcggtggcgttcatacaccacttcattttcatatgcctgatatgctttcgatccttcttgaagcttgcacggataaagtccgaggcgcagtgttccgccgaggtcttcaatgtccttttgttcagggagaaggtcgataatcggatacggtgtagacggatcgatttcggctgagtgcgctccttcaaggccgagcacgtttctcgcgtattcaatcgatgccacctgcattccgaggcaaatgccgaagaacggaatcttttgttcgcgggcatatttgactgtcgtgattttcccttcaacaccgcggtctccgaatccgcccggaacaagaataccgtccgcattttgaacaagatcggcaacgttgtcttccgtcacttcttccgcattgatccatttaacttgaatgtctgcatcaaacgcataacccgcatggcgaagcgattctacaactgaaatgtaagcatccgggagctcaacgtatttaccgaccaaagcgattgttaccgttttggacagatttttcacctttttgacgagttctttccactcttccatatcggcttctctgcaatccagcttcaagtggctgcaaaccaggctgtccaggccttgtttttgaaggtcgagaggaatggagtagagcgtatccgcatctccagcctcgatgacggctttaggatcaatgtcgcagaagagcgcgattttatctttcatgtcctgagaaatcggcatttctgttctcacgacgatgacatttggctgaatgccgaggctgcgcagttcttttacgctgtgctgagtcggctttgttttcatttctcccgccgctttaagatatggaacaagcgtacaatggatgtacatcacattgtcgcggccgacatcgctcttgatctggcggatcgcttcaagaaacggcagcgattcgatgtcaccgacggttccgccgatttcagtgattacgacatcagcgtgcgtttcttttccggcgcggaatacacggtctttaatttcatttgtgatatgaggtattacctgtacggttccgcctaaataatcgcctctgcgctcttttttcagcaccgtggaatagatttttcctgttgtcacgttgctgtatttatttaaattgatgtcgataaagcgctcataatggccgaggtcaagatccgtttccgcaccgtcgtcggttacaaacacttcaccgtgctgatacgggctcatcgtacccgggtctacgttgatatacgggtcaaatttttgaatggtgacattcaaacctctgttcttcagcaggcggccgagcgaagacgccgtaattccttttccaagcgaggatacaactcctccggttacaaagatatattttgtcatttctgtacccctctcttcgattaacgcttatttcttaaaatgctctttttatgaaaaatcatttagatcttttctaaatgatttaaatgattaggaggcggaaaaacaagaaagctccctttcaatttcttgaaagggagctgatagtccgtatcactcgaatctcttcgttttgaagagcccaaaatacatactacctagttcgcctgtgaaagtcaagatcgatttaaacatgaattccgttcagaaggcaattactcttcgtcttcctcttcatcaaaatcttcatcatcatccaggatctcgtcttcaagatcatccagctcatcatcgtcggcttcatcgatttcatcgaattcatcggcgtcaatgtccaaatcttcttcgacatcgtcaagaagaatatcatcctcgtcgatttcttcgaattcgtcaagatcaagatcttcttcaaccgcttttttcgcttttttctttttcgcttttacagtcggctgggtttcttcatcaagctgatcatacggataccagctgcgcaggccccacgtttggtctgacagcgccaaaaagcgtccgtcgatatttaaatctgtgtagaactgggcgatgcggtcttccagctcttctttccccattccaagcaaggaagccacttgatctgttagctcctggaatgtaatcggttttttgtgttccgagaaaatttcgtatgcgatttcaactaaagccatttcctttagctgctcctctgagtattgtttcaaactcatcgccagacactccctttctatcttcatgtatgtatctactatctctgtcatagaaaataagcatgtaatccctgtctttacgacaaaccatacctctcattataaacaaaagaaatcactttatgccacctttattcccgttaattcaataatttttgccggttgcattggaaatcggcggcaagcgggattgaaacatagaacagccgggagcgtccggccccttcaaaacaaaaaaactgcgccggcagcctgtccgccggcggcagatcaagccgggccagacggcgattttccacccttatttcatcagcattctcgaaatgacgagcttctgaatttcctgcgtaccttcatagatctgtgtgatttttgcatcgcgcataaagcgctcgaccggataatcctttgtgtagccgtacccgccgaatatttgcacggcctccgtcgtcactttcatggccgtatcccctgcgtaaagctttgacatggcagaagcctttccataaggcagtccttctgattccagccatgccgcctggtaggttaaaagccttgaagcttcaatctccgtcgccatatcagccagtttaaaagcgatgccctgctgctcggcgatcggcctgccgaattgcttccgctctttcgcatacgccttcgccgcctcaaatgcgccctgggcaatcccgacggcttgagcggcaattccgtttctgcctccatcgagcgtcttcatcgcgattttaaagccttcaccttccccgccaaggcggttttttaaaggcacgcggcagtcctgaaagatgatttcggttgtcggtgatgaacggatgcccagtttcctctctttttttccgacagaaaagccggggaagtccttttcaacgataaaggcggttgtgcctttgtgtttctgttccggggcaaggttggcaaacacgatgtagaagtccgcgattccgccgtttgtgataaagatcttcgtcccgttcaaaatatattcatcgccttttttttctgcggtcgttttcatgccgccggcatcggagcctgaaccgggctccgtcaatccgtaggctcctatcttttcgccgcgggccatcggctttaaatattcctgtttctgttcttctgttccaaatgcataaatcggccagcccgcaagcgatgtatgggcagacaaggtgacacccgttgaggcgcagactttcgaaagctcttcaaccgcgatgacgtaggcgagatagtcgctgccgattcccccgtattcctctggccacggtatacccgtgagccccaattccgccatttttgcaaacagttccatgtcaaaccgctcttcctcatcccgctctttcgcagtcggctccacctcgtgatgggcaaagtcgcgcaccatcttctgtatcatttggtgctcttcactcagcttaaagatcatcctttttccccctttgacaccttataaatgtttaccgatgacgatccgctggatctcgctcgtgccctcataaatttcacacactttcgcatccctgaaatatcgttcagcgctgaaatcctttgtgtatccgaaatctccgagcagctgcacggcctctccggcgacatacatcgccgtttccgaagcgaacaatttggccattgaagcagctttccccgtctgcatgccttgctgtttcaacgaggcggcctggtagacgagaagcctggccgcctctgtcctcgccgccatgtcggccagcttaaaggcaagcgcttggccgttcttatacagctctccgtccggataccgtttttttagaaattgaacggcttcagaaagcgctccctcggcgatacccagagcctgcgccgcaattccgatccggccggtatccaggttggacagggcaattttgaatcccattccttcctcccccagcagctgccgggcgggaatgacagcgttatcaaaatttaaagtgaccgttagcgaaccgtggagccccattttctcttcattttttccgatgaaaaagcccggcgtgcccttctccacgataaaagcggaaatgcctcccgttcccgcctccggatcggttgaagcgaaaacaagataaatgtccgcggctccgccgtttgtaataaaaactttcgttccgttcagcacataggtatcgccgcgcttttcggccctagtttttagactgcccgcatcggaaccggcactcggttcggttaaacaaaaagctcccaagtactgccctgctgccagctttttaacgtagtgctctttttgccgctcattaccgtttaaaagaatgggaatggtgacaattgacgtgtgtacagatagaaccgcaccaagaacggcgcttttctttgacagctcatgtatggtcatcatataggtgataaagtcatgaccggccccgttgtacttagccggtatcggaagccccatccagccgcgctccgccattttcttcaaaagagaggttggaaaacggcctttttccatttcaggtacaaaaggagcgacctcctgtttgacaaaatcccttacaaccttctgcatgcgggtctgctcttctgtaaactgaaaattcaagctcacccctccttatgtcggctgcttttcatacgtataaaaccctctgcccgttttctttccgagtcgtcctgcgctgacatattgtttaaggagcggacaaggcctgtacttatcgtcgccaaagccttcatgcagcgtctccataatatacagacacgtatccagaccgatcagatcggcgagagccaacgggcccatcggatggttcatgccaagcttcatgattccgtctatgctttctttctcggcgatgccttcataaagtgcaaaaaccgcctcattaatcatcggcattaagatgcggttggagataaatcccgggaaatcccgcacctctatcggaaccttgttcatccgctccgccgcagccacgacggtttcatatgtttcgccgctcgtctcaagccccctgatgacttcgacaagctgcatgacgggaaccgggttcataaaatgcatgccgatgacgttttgaggtttttttgtgacggcagcaagttccgtaatcgacagggacgatgtatttgatgccaatatcgctgagtcttcggtcacttcatcaagccgcgtgaaaatgtctttttttacgtccatttgttcaacagccgcttcaatgatgagaaaagcttcccgcgcttcgtcgagcgcagccgacggagaaaggcgctggtagatttgcttcacatcttcatgcggcagcttgcctttttccgcctgtctgaaaagctggccggaaatgcgcttcattcctttttcaatttgttcaggtgatacgtcatacatgtaaacattgtatccggcctgggcagagacctgagcgatcccggaccccatctggccggctccgatgaccatgatcgtgtcttttttcatctgaaatccccctttttatacctcgatcatcacggcgtctccctggccgccgccgctgcaaatggcagcaatccctataccgccgccgcgccgttttaattcgtacataagcgttaaaatgattcttgctccgctcgcgccgatcggatggccgatcgcaatggcgccgccgttgacattgaccttctccatgtcaagacccgcgatctttccgcttgccaaagcaaccgcagcgaaagcttcattgatttcaaacagtttgatatcagaaagctcagctcccgttttgttaagcagttctctgatgacaagcccgggggttttcggaaagtcttttgcttcgactgcaattgatgtgtgcgctttaatgacggccggcgccttcacattgagttcctttgccttgtcttcattcatcacgataagtgagcatgccccatcatttacccccggcgcgtttcccgccgtaattgtcccattatggtcaaaaaccggggcaagctttgacagcctttccattgacgtgtcgcgccgcggtgcttcatcttgatcgaccgttaattcgccgccccgcttctcttggatgctgaccgggacgatctcttctcctagcgcgcctgaatccgcagcgtgtacggctcgcatgtggctcctgagcgcccaccgatcctgctcttccctagcaatctccaactctttcgcagcggcatttccgtaggagcccatgtgaacgcccgtaaatgagcatgtcagcccgtctgcgatcatcaaatctttaaccgccccgtctcccatcctcagcccccacctcgctttttgaagcaaataaggggcgtttgacatcgattccatacctccggcggcaatgacctccgcatcaccggccctgatgatctgatccgccattgtgacgcttcttaaacctgaagcgcacactttattaatcgtttccgttttgacgtcccacgggagtcccgcaaaacgcgcggcctgcctcgacggcagctgcccctgtccgccttgaagtacggagcccatgatgacttcatcgacatcctcaggatttacaccggaacgttttaatgcctcttttacggcgattccgccgagctccgcagccgtctttgactgaagcgcgcccccgagttttccaaaaggcgtgcgtgcgccgcctgcaataactgatctcgccacctgacatcctctccccttatcatgatttgtacataccgaagataaaagaaggcggagatccggctcacaccttctttatttaaaacctgaaatccgtctatgaggcatgttctttttgctctgacccgaatacggcgcgttcaagcagctccgctacatcatacgtgccgacctgatcctccaattccttggcttttgttccgtcgccgagcatcgtcaaacagtaaggacagcccgagctgatgacagaaggtgatgtgctgagcgcctgctccgttctggcaacgttgatcctcgcgcccgcctcttcctccatccacatgaggccgccccccgctccgcagcacattccgttttcacggctgcgctccatttccgctaaacggatgcccggaatggagcggagaatagcgcgcggcggatcgtaaacctcgttgtagcggcccaaatagcatgaatcatgaaaggtgacggtttcgtgaaccggaaactcaggtttcagctttccttcttcaatgagggcagcaagaatttctgtatgatgataaacttccgctttcagaccaaaatcaggatattcatttttgaaaatattgtatgcatgcgggtcgatagttacaattttttgaacatcatttttttcaaattcctcaatgttttttgcagctagctcctggaataaaaactcgttgccaagccgtctcggcgtatcgcctgaatttttttctttattgcctaatatcgcgaacgtgaccccggcttgattgaggaggcgagcgaaagccatggcgatcttctggcttctccggtcatacgatcccatcgacccgacccaaaacaggtattcaaaggactcgccttttttcttcatttcttttactgtcggcacctcaacatcgtctcttatatcacgccagttttcacgttcttttcggtttaatccccaagggttcccctgcctttcaatgctcgtcatggcgcgttgggcatctgcatccatttttccttctgtgagcacgagatagcggcggagatcgatgatcttatcgacgtgctcattcatgaccgggcactgatcttcacaattccggcatgttgtgcaggcccaaatttcttcttctgtgatgatgtcgccgattaagctcgggttgtaaagttctgaagcagccgcttcccttgacccttctccccctgccgccatggccagctggttgcctttcgtatgctgaaagagcggtgcgggtacccaaggcgttctcgatgtcactgctgctcccttttctgtcaaatggtctctgagccgcaaaatcagatccatcggcgaaagcatcttgcctgttcctgtagccgggcacatattggtacagcgcccgcattccacgcatgcgtaaaggtcgatcagctgggactgcctgaattcctcgatccgtccgacgccgaacgtttcttttgtttcatcttcaaaatcgattttttgaagctttcccgggtttgtcagccggctgaaaaatacgtttgccggtccggcaattaagtgggcgtgctttgactgcggtacatagactaaaaatgtcagcaggatgagaaggtgcgcccaccacgccgcgtagaacactgccgctgaagcggtttcccccataaagccgaaggcaaaagcgatgcctgatgccatcggttcgtgccatgataatgaatgttcatgccagatcatgttcataccgtttccgagtaaaacggtaaacatcaagccgccgatcagcatgagcacgatccccgacttaaaattgcgcttcagcctgacgagtttttctatataccgcctgtgaaaagcccagactaccgcaattaaaatcatcagtgtgacgatttcctgaaaaaacgtaaacgccgggtagacgccgccaagcggaaggccttgatcaggaacgagccctttcaaaataaaatcgatcgctccgaactgaacgagaataaagccgtaaaaaaacatgacatggatgatgccgctttttttatctttaagcagtttcttttggccgaacacgttctcccatatcttttgaaggcgctccttcgtccgcttatcaaaatcctctttttgtccgagcctgatgtaactgattctcgttctgatcaaatagacgaacagataaacggcgtaagcggttacacctaaaaacgcaatgaaattcaacgacagcaagacattcatcagctgctccccctttcatttccccaaccttaaatccccttgaactacctttatcttaaataatgaatgagtgttcagtcaatatattttcataaatgcaggaaaatagggggacactattctttacacgaaaaaagggagtgtcttcattggtgccgcttatgattatggtatgttttctcatcctgcttcttgcgctcgatttccattttggccgcaaagcctttgagaagaaagcctacgagcccgttttttcagagaagaaaagcgatattgaactgattcataatggagaagacttgtgtgagcggctgctggatgacatccgccaggccgaatcgtcggtgcatgtcatgttttatattgtgaagaacgatgacatcagccttgaatttttgaaggtgctgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttataaaacgtacgtttatcctgcatgacatgcgggtaacatttcaccaaagtgatgattacatacggaggggatgtacgatgaaccaagcagagtcgattaaactccgcgcccaatcgatgacgttaaaaaacttgattgagctgtacaagctttgccgctcagccagacatcagctatatatatgctcaagaaaaacgatgtgcaaaatcaaagatttaattgagctggaaatgttcagaatggccaatcgcgaaaatgagtgcctgattgtcatcgaagggaaaatggctcaggaattagtaaaaaaagcacaatcgattctttctgacgctcaagttcaataagggaaggcggaagttcttcctttgcgagacgcctcctcaccaaatcaagaaaaaatcccccgttcaatggacgggggattcgttttacattttttcaggcgctgatacgccgatcagcttgagggcattatttaatgtgatttgcgttgctttcatcaatgataaacgggcccggcttttttcttcatctgccggatcgaggactttctcagcattgtaaaagctgtgaagcacagatgccaattcaaaaatatagtttgtaatgcggtgcggaatccgcttctctgcggcatcagcgacggcctcagggaacgagccgatcactttaagcagatcatactctttctcagaaccgatcttcgtaagatcaaggttcccttcaaaagaaatgcctttttcttcgccttggcgcagcatgctgcaaattctcgcatgggcgtactgcgcgtagtaaactggattctcattagatgttgagacggccagatcaaggtcaaagtccatatgggtatcggcgctgcgcatcgcaaagaagtaacgcacagcgtcaaggccgacctcatcaataagatcgcgcattgtgacggcttttccggttcttttgctcattttcattttttcgccgtttttgtaaaggtggacgagctgaatgatctcgacctcaagcgtttctttgtcataaccgagcgcttcaatagccgctttcatgcgcgggatatagccgtgatggtctgctccccatacattgatcagcttttggaagccgcggtcaagcttgtctttgtgataagcgatgtcaggcagaagatacgtgtaggatccgtcttttttgatcagcacgcggtctttgtcatcgccgaacgccgtcgagcggaaccatgtcgctccgtcttcttcatagatatgccctttttcgcgaagggcttcgagcgcctgatcgatctttccgttttggtaaagcgatgtctcagagtaccagacatcaaatgggacacggaaattctccaggtcttcacgaagtttgcccaattcgtactttaagccgtattcgcggaaaaacgcgaggcgttcgctctcttcttcatgaacaaaacgatcgccgaattcgtcggcgagcttttggccgatttccttaatatcttcgccgtgatacccgtcttcaggcatcggcttatcttttccaagcgcctgaaagtaacgggcttcgacggataacgcgaggttgttgatttgattgccggcatcgttgatataatattcgcggctcacttcataccccgctttttcaagtacattgcagagggaatctccgacagcggctccgcgggcatgtccaaggtgcaggttgcccgtcgggtttgctgagacgaattccacctggacgcgttccccgcccccgatatttgtttcaccgtaggcctctcctgcttcaagcacagccggaatcagcttcgttaaatattgattgttcatgtagaaattgataaagccaggtcctgcgatatcaagtttgtcgatcgacgcttttcctttgtcaaaggatgcgacgatttcttcggcaatattccgcggcgcttttttggcgattctcgccagctgcatagccatattagtggaatagtcgccatgcgacttgtctttcggaacttccagtacgacttctggaatctcgctttcttcggcgaggccggctttcatgacagcttccttaatttcctgcttcagcacatctttcatttgttcgactatgttcatgactcgtgtcctcctctatacgaaatcgacatcttatgtaaatgcttttgttcatcgcttacaatcatatcgtactcaatgctgatctttccgtccggcggctgatgtgtgactgatacagctttagtatccacgccgagctcgagtctgccgaatggcattttataatgagtgacggtgcggctgcccggcctgaagcgctgtttcatttcgatggcgccggaacgcatgaccagaacttcgttttcacttgccttgacgatcgtcttcacctttccagcatcatgctcttcatgataagaaagatatattttatcttttttcatataataaaatccagttgtccggaactcgatcgtctccgtgtccgatccttcccggataacagatttcacatagatatgaacgggtgtctcctgatccattccgacacttcctttttcgatccgatttgacttgattagtataatcattcgggaaaaaaagttcaaccgcagctcctttatatcatcttaacagaacggacgggaagataaaccattttctaagaaaaaagccgtcctgaaaaaaggacagcctgttttatttcacccagccgagcagcatttcgcgaatcagcttgcttgccgtatttgcggtttgttccgaatggtcatagacaggagcgacttcgacaaggtctcctccaacgacattgacgtctgagcgggcgatttcgtgaatcgaagcgagcagctctttggatgtgatgcctccggcgtcaaccgtaccggttcccggcgcatgcgcgggatctaagacatcgatgtcgatcgtcacataaaccggacgccccgcgagtttcggcaggacggctttaagcggctcaagcacttcaaatttagaaatgtgcatgccgttttcttttgcccattcaaattcttctttcatgccggagcggatgccgaatgaatagacattgccgggtccgatcagttccgcggctttacggatcggcgtcgaatgcgagagcggctctccttcatagtcgacgcggagatctgtgtgcgcatccatatggatgatggcaagatcgggatattttttgtacatcgctttaatgaccggccatgaaacgagatgctctccccccataccgagcgggaattttcctttatctaaaatgctgtcgacatattcttcaatcatgtcgaggctcttctgcgggttcccgaaaggcagcgggatgtcgccggcgtcaaagaaatgaacctcttccagctccctgtccaaataagggctgtattcttcaagtccgatggacacctcgcggattctcgccggaccgaagcgggagccgggacggtagctgaccgtccaatccatcggcatgccgtaaaggatggcgtccgcctcttcccaatcggggcggcttgcgataaacaccttgccggaatatgcttcatcaaatctcatcttcaaaaacctccctgaaaaaaagcgcagaatgccatcctgcgccaaactgttttatttgattaaatcgctgacgaatttcggaaggacgaatgccgctttatgaatttcttttgtgtagtatttcgtctcaatatcaaagaagcggctgtcctccacttcaagaggatcgtattttttcgaaccgatcgtaaacgtccacaatccgcttggatatgtcggaatgttggccaaatacagctttgtaatcgggaagatctcttttacatcgcgctgaacgtttgtgatcagttcaggtgtaaaccaagggttgtccgtctgagcaacgaaaatgccgtcttcctttagcgcttttgctatgccggcgtaaaagccttttgtaaacaagttgacagcaggccctactggctcggttgaatccaccatgatgacatcgtactcattttcagattgggcaatgtgcatgaagccgtcatcgacttttacttcgacgcgcggatcgtcaagtttgcctgcaatggaaggcaagaatttcttggaatattcgatcaccttgccgtcaatatcgacaagcgtcgcttttttcacgctcggatgcttcaaaatttcacggataacgccgccgtctccgccgccgaccacaagcacatgctcaggattcggatgcgtaaacaggggcacgtgcgccaccatttcgtggtagacaaattcatctttttcagatgtcatgaccatgccgtccaaaaacagcatgttgccgaattcttcagtctcggccatttcgagcttttgaaaatctgtctgctctgtatgtaaagtcctgttgattttcattgtaataccgaaatttttcgtttgcttctctgtataccaaagtccgctcaaagcgtcatcttcctttcgtgataagctgtatttcaatctatttttctcgcctgcggcggcgattattctgcactgaagcatcggcttttgcctaaggaaaaagtatagaggaattgcaggtgattgtaaagacggatcgattcattttcaggagtcattccaagtccattatattcccaatcgccgatttttcttttataatggctaagctaagcacagatgtgcatactgtgcgcttttggaggtgttctcatttgcagagcaaacaactgctcaaattgtatataaccagccgccggaaaaggtttttattgatattttttctgatcggagcggccgttttgtttttcagccccgtttatatccgggaggctgccgttccgtctttgccggattggcttctcgaagtcagcggatctgtttatttgatgcatatggtcgctgtcctgtccgcagcctgtttgttctacggcacagcgaatggatgcggcgttcagcaggtgcaattgcaacaaacagaacggtgttgccgttgattttgctcggctgcaccgtttctgcttttgtgatgatctgcctgctgttttggagtgcggccatcggctggtttacattcggcggctacggtgcggagaatgttcatcctttttttgagctgtcgggttctcccctctggtttgttgtctcacgcctgttcattgactggtggtcgctttgctttctgatttttctcggcttggcgggagtgctgatcgcaaagaaagagcagcttgctctatggctgccgcttgcgtggtcctcgggtttaatgctccttttcaaattcaatatatcctttaaagggctgctcccgggggaaggcatgctgttgtccatccatgcagcaggagcttccccgattctggccgcatcagtcagcgaaggtgcagttttcgtattatggctgatttcatatgtggcgaccgccaaaaaataggattcctcatattgctgtcttaatctccgcagagggtctgccgttttttccttcccgcttgtttaaatcctcctctttttcctcataatgataagaacattttatttatccgggaggagatttgaacatggacatgatgacggacaagcgggtccgtttaaccatcaagacgatacgcgcatttttgttcatgggagcattgatgctgatcttcctttcaatcgttgtcatgacggtggtcttggcggccaaatggcaaggcgctccttcgattcaggtgccgaggtctaccgtgctgtatgacggaagcggaaagcaaatgggggaaacgcattacgggcaaaagcggtactgggtttcgctgaagaacatcaatcccgcagtcatcgatgccacgcttgccgttgaagaccggaactttttccggcaccacggctttgactatatgaggatgggcggcgccctcattgccgatttaaaggcgatgtccaaagttcagggagccagcaccatcacccagcaatatgcgagaaacctctacctcggccacgataaaacatggaaaagaaagtggaatgaagctttttatacgataaggcttgaacaaaactacacaaagaaagatattttggaaggctatttaaatacgatttattacgggcatggagcatacggaatcgaagcggcttcccggctgtattttggcaagcgggccaaagatatcaatacggcggaggctgcaatgcttgccggcattccaaagggtccttcagtttattcgccctttgtcaatgaaaaaaaagcgaaagaacgccaggaaatgatcctgacaatgatggagaaacaaaacaagctgacggaaatgcaggcggcagcactgaaaaaaatgccgctccgctttgaaaaacaggataagcaaacaaccgaaaaaaccgctccgtacttttatgacgaagctgttaaagaaatttcgcgattgctgcgtttgacgccggagcaagcggaaacaggcggctacaacgtattcaccacgctcaacccgcgtctccaaaaaattgccgaggatacgatcgaacacacgatagattcgtcatccgacattcaggcgggatttgcagcgatcaacccgtccgacggcagcgttctcgcgcttgtcggaggacgcgactacgaaaaaagcccttttaaccgcgtaacgcaggctatgcggcagcccggctccaccatgaagcctttcctttattattcggcggttcaaaacggctttacaccggccacccgaatgaggagcgcggaaacgacatttgagctcgggcaaggcagcgcttattccccgagcaactatcacggctattatgcagacggtccgatcacgcttctgcaggcactggctttgtccgataacatttacgccgtgaaaacccaccttttcctcggcatggacaaactgattgatgccgcaaagcaattcggcatcaacagcccgctgcaaaaagtgccgtcgcttgcgctcggaacatcccctgtgaagccgattgaaatggtgaacggatacgccatgtttgccaacggcgggaaaaaaatcgaaccttcctttattacgaaaattaccgatccgaacgggaaggttctttatgaaaaaccgaagcggagcaaacaaatccttgacccaaaagcggcttttatcacggcgaacatgatgagcgggatgttcgacaaatcactcaacggctatacatctgttaccggccggacgatcgcagatcagctgacgcgccgatacgccggaaaatcgggaacgaccagcaccgacagctggatgatcggcttttatcccggtcttgcttcaggcgtgtggacgggatatgacaaagagcggacaatcgatgccgtcgcagagaaaaactatgccaaacaaatttgggctgagtttatggaaaaagcgcttgaagacgcgcccgccgcagctttaatgccgcctgaaggcgtgaaagggatgtacatcgacccggctacaggttatgcggcggcgcccagctgcccgtccaaatatttcgcttattttatcaaaggtactgaacccgagcaggtttgctatggaaaggaaatctataaggagcaaaacgccgggcacgaaaagcccgccgctcccccccataagcggcaaaagtggtggggaaaatggtttaaaaaaggagaataaactttttagggggatagacgaaccccccggacttcatggcagtccggggggtttttcctattgctggagcagtccctttttcagctcgtctgatgaacggtcccaaagcccttgatcatggtttttcagaaaatcggcaagaacgcgcttagaaccttcatccatatgctcgacgataatcttccgcttcatcgacttatccattaaattgacgtgctccggaagcgatttgtagccgcggcggatgcttctgtcgaccgtcatttcgcatgccgtcacacccgcataataagggccttcttccctgcggtcgatcgtaacccacacaagccagtaaggttttccgttcggcacctcttctttgttcggcaaaaatttgattcctttttcaaccgtgctgcgggcgtgcatggcgccgatatccacaaacgcttctttctcttcaacatcgacaatgacaggcgagatgttgtcaaggcttaatgcgcctgctccaaatcccccgtgtccgtctgtcggatcgcttttaataatgttgaatccgattgtttttttcttttttccttgttccatcaaaaatacctcctacatcagcggccggaaaacgctgttaaatatcgatatgatcaattcccgcccgtcattcaaaaacggccagaatacatattggccaagcggtgtaatgacgataatcagaaagacgatcgagccgtacgcctcatatttcgacagcttcgcccgcacttcgggggcgaccacatcctgtataacccgaaaaccgtcaagaggcgggaacggcattaaattaaacagaaataaaagcaggttgagattcacccaaatcgtaaaaaattgaagcaaaccgctgtaaaaaccggcaggcagcgtcccggacagcttcacggacaaaagcagcaatataaaaccgatgaaagcaaggatcagattgctgatcggtccggcgattgacacgagaaatccggccagcctcgggtttttaaaataaaagcggttaacgggcaccggctttgcccagccgaatcccaatataaagatcaaaatcgttccaaacggatcaagatgcttaagcgggttgagcgtcagcctgccctgccgtttggccgtctcatcgccgaatttgtaagccacatacgcatgggcgacctcatgcacagtgaatgcggcagcaagtgtcaaaacaacatacggaatcatttccagcggataaataagaaaacggtctaaaatgtggctttccctctttctcatatacaaagatttactatctccagtatactataagagaacctgatgctaaagtgagcagccattttttaaaaggaggaggagaacatatgccatacgtaactgttcaaatgctggaaggccgcacagatgaacaaaaaagaaatctcgttaaaaaagtgaccgaagccgtctccgaaacaacaggcgcacctgcagaaaaaatcgcggtcatcattgaggaaatgaaaaaggaaaactacggtgtcgccggcaaacgaatgagcgatatgtaaaagaaaacggcgttcgccgcttacgcgcgggacgccgtttttattatttataccaagctttgtttttagtgatctggctattgtgagctgaatcccaaacatcgaccgtgtatgcgtagtcgtagttcataatgcagcggattccgcttccttgcgcatcgtggttcaagccgaagttatgggaaaattcgtgggttgcagcttttgccgtgttggccgttccctggtcgaggtttacgctgaaggcgctgccgttcggcttgctgttgtatacgtatgcgatgccgccggcgtcaaaattactgttcgccgtaaatccgacgacgaatttatagctgcgcccgctgaaattgctctgaaggtttgatagaatttgagagctgttgctgcctgaagaggtccaaggcgccacagcttcgacgacaaaatcaacatcgtgatccctgttgaacatgacatccgcctgctcaataatttggacgattcttgtctgccaatcgctgtatttcgcccgatactgagcgtcagccacggcaaggacgctcactttctggcttcccgtgcctgcctgggttgaaaacgaccctttgcccgtattctttttaaacgttttcgttcccgtcacatttcctttctcatccagtattttcgtattgaccgttctttcaatttgaacttttcctttcaagtctttaaaatctttcgctttaggcaaagaatcaatataagttcctcttgcttcatgatcgtgctcgtgctcatgcccgcccgtcttggcggcaccggccgtcacaccgggaatgagactgacggaaagtaatagagataagaataaagaacgtttcttcactgcaaaacccctccttattttttgaacgaatgaaaaattctgctagttatcaaaaaattccttcaattcatccaaaaagaggaaatattacatacgttcttttcactgcttctttcaatttccctacaaaaattccaaaacgcagacaaaaaaacaaaccaaaaaacctaccgtttttcggcaggcttatgaacaaagatttctgagcttttttatgtaagcgacggcttcatcgaattcttcgtccgtataccgctgtttgctttttacggtaaacactttttctctaatctcttcctgctccagcccctcaaaatacaaaatcgtcgacaccagttccaaaaaacgcgatgactggccgtttacgtcgtctaaataggctttaatatcccgcatatccagctcacactggctcaaaaactgctttcccgcttcagtgggtgaatagcggtattgataatagccgccctttttttctttgacttcatggagaaatccgagattgcaaagttcttcgacttgaagcgtcagctcctctgaataaggcccgtaaaaatgaaaatcatacttttcataaaaaggaagctccaatttctttgcgatataaatgattttctgcagctttttccgcccgacaatctcccccgaatccgagaagaccttcatcagctttgcatgttcttttaacaaatctccgccatctccttcatccttttctttctatttcagtccgagcaattctttcattcttttcgcatgacggccgtcaggcaacccttcgattaaatcgagcgggaaatacagcttatggtccgttctccgcttgcctgatatcgcatcgacaatatcggactgccgcgacagctccttaatctggccgttgtgcgtcagcaattgaatcgggaggcgttcctcttcttcccccggtctgtagaaatcataaggaagatctgaggacgaatccaccacaagataatattcgggatcaatccctgattctttaaacaagttggtcagttcaaagtaagtcgccatttcctcattcggattgaattccgcatactggaacagcctgcggttgataaaacggcggcataaatcagacaaaatttcgtcctcttctttttcccaggcctgaaaataataaagaatgattgattcatcaagacttaaataatcttccaatgtgacattgccttcaaaaatagaataaaaatgcactggcgcatgcgtgaaaacatagccttcctcatgaagctgctttgcacggtgaagaatcttcgtcaaaatcacttccgcacttcttgtcacaggatggaagtagacctgccagtacatctggtaccggctcataatatagtcctcaacagcatgcattccgctttgcttaatgacgatttggtcttcgcgcggccgcatgacgcggagaatccgctccatatcaaaatgaccgtagctgacgccggtgtaataggcgtccctctgaaggtagtccatgcggtcagcgtcaatctggcttgagatcaggctgacgacctgcttattttgataggttttcgcgacgacttcagcgacatcctttgcaaatgtcggacttaccttgtttaatactcggttaacttctgtatcgcctaaaatgatcgctctcgtaaagtcttcatgatcaagccggaagaccttttcaaacgaatgggaaaacgggccgtgccccaaatcgtgcagcaatgcggcgcaaaggcacagatcgcgctcgctgtcatcccattcctccctgcctttaaaaacgtcatcaaccattcttctgacaatttcatagacgccgagagaatggttgaaacggctgtgttcggctccgtgaaacgtcaaataggtcgtcccaagctgtttgattctgcgcagcctctgaaattcgcgggttccgatcaagtcccatatcagcttgtctcgtacgtggacatagcggtgaacaggatctttaaacactttttcttctgataattttccgtttggatacgccatttttgtccctctttttttcaaacgtgaggcaaactgatcgctgcccatccgtctctttttcttcggaaaactaaatgtatattgtaagtattgcccgatctgcttgttttctttaaggtctgcttctattatatcgagtctgtttttttgaaaacatccttgaatttacccggccatttgttccagcctgccaaaaaaccgtcaaacaagcaaaaacgcctgacccgttagggaggcggttattttttgagtttctttttcactttttcgatcagctcgtcttcatcaggagctgacagcggacgattattgacaaacgcaaacgatttttttcgtcccggcccgcagtaagactggcagccgatttccacttttgcatccggatcaatttctttcagacggggcaagagcgtctttaaattggtggcctggcaatcgtcgcatactcgaaattcattagccatttcatacgcttcctttcgttttgttcatctgtctttatgaaaggcattcaactgtgccgaacttttataaaaaatgacaccatccttcattttacaaggattctttcattcctgcaaggatcgcgctaaaaaaatcagttcctattcttttagcaaacttgtataaatattttccaaaatggacaatctaataccaatactgacaatgggagttgagaagtgatgaaacaaagacaagacgcttggtctgaggaaaatgatttactgcttgctgaaacggtattgcggcatgtcagggaagggagcacacagctgaacgccttcgaggaagtcggagacagactgaacaggacatcagccgcctgcggttttagatggaacgcagttgtccgccaccaatacgaaaaagcattgcagctggctaaaaaacagaggaagcaaagaatgcgcgccctcggaaacggacagccggcgaaaaaacgcttattatacaagccgccggtcgaaacgaatgctgaacctcctgcagaaagcgttgttgagcagaagaaagcaaccgcagattcaagcgaacagcagccgatcgccagcgagcatctgccttatgttgatgagagctttaaagaagagttagctagtttatctcaccttctatcgccaaatcagccgcaggccggccatacagccgatacatcgaaagacatgacgatcgatgatgtgatccgcttcctgcaaaactatacaggaaacgaagaacaaactgccgctttaaaaatggaaaatgaacgcttaaaacaggaaaacgaagaactgacgaagaaagttgaaaagcttgaagcggaagtcaaaaagctggaaaaagaccagacaaccatccaggaagactacgaaacgctcgtaaaaattatgaaccgtgcaagaaaactagttttattcgaagaagacgaacacgctgcgcccgccttcaaaatggaccggaacggcaatttagaaaaaatggctgaatagcgctctcagagggtgcggcagagacgttcaggcagcaaggactgacaatgcatacaaacatttttcgatacgaggatacccctttctttaaaaaagggggtatttttacctttctgcggcttgctttcatatgacaaaaatttcataatagggatagcaattcataaggcggggtattcgatgaagtttgttttatatgcggttcagttcggcactgcggcccttttgtttttgttttctgcattggcaagctggtatcaaggcagcgagcttttaaaggtgccgtgggagtggaaatatacagccaagtttacaagttggctgtacggagaggactccattaaaaacgcacataatatttcacagcttgattttttcgtctatgcggccaagcatacgccggcaaccgttattttaatggccgtcagtttggcgtatatcatcgctttggcggcttatcttctcatcaaaacatatgtaaaacgaaaaagcgcttcgagcgcagcataaaaaaaccgctccggaagcggtgaggtgtggcaaaatcctaaaacgttcaaccgttttaggattttgccgtctttgaagcattttacagcccgctggtttttcaccgctttaagcatgcctgacaacgaatataaaggcggcggaggctcttcttctatccaaaaaccttttcattccgttcaatcatgcggacaaggtttttctcatacacttcctcttctgcgggcgtgagagggccttgataaatctccccgcccagctctttcagctgtgtcagaagcaagagcatcaagtcctgcaccgaaatgtcttcattgagaagctcagaaagcgaagccatcgtttccgggcgaatatcgggataaacggcttttgttttcccgcgcatgtctttcaaggcggtgtcgtaaaagcgtttgatcagctcagcgcgcccgcttccgctttgatcagcgcacaaataaatttgaacagccactccgcctctcaggcgcctctgggaaattcccgcaaatttccttcccccgatgctcaaatcaaagcttcctggacagtaggagcctttgatttcataggcttcgattgctgcgtcataggatgacagcattcgcttaacgagctcaaacatcgcttcatagcctctgtcgatatcaattccgtttttcttatcctgaaaaatcagggaaacgtttaaaaccccgctgtccaaaacgacggccagtccgccggaattgcggacgatggcttgatagcccgcttcttcaagcaatgaaatcccttcttgtaaataagggagccttgtatcctggattcctagcacaatcgtgtcatggtgcacccaggaacgcgcggtcgccggagataaacctttcccgacagaagcgcacagcgtatcatctatcgcaaatgattgttttgcatcaaaatatgggccgagactggattggtcaatgattctccatttcggctggatgagtagatcaatcggttgctttgccatatatagtgtaaaccctttcgttttgcatttcagccaacatccattataccatttacgaaaacatgtggtggaaattttcttatctccggcgcttccttcattcaagtgacgcttaaagacggttctccgaattcaagcggcagcccgacgtaattctcggcaagactttgagcggccgccgttgaagtcgtaacgtggtcaagttcagccaattgaatctggtagtcaaaaggggtgtagccgtgatggcgatgcagcagggatgtcatataccaggaaaagcgttcagctttccagacgcggcggaggcaagactcagaatagccggccagccgttcgattcttccggtttcgtaatagtcttcgagcgcccatgcaagccgctggacatccgccatcgcaaggttcaggcctttcgcacctgtcgggggtacaatatgcgcggcatcccccgctaaatagagtctgccgtattgcattggatcgcatataaagcttctcatcgagacaatgtttttttgaatgatcgggccttcagtcagcttccatccgtcatcggccgacagccttaggtgaagcttctcccatatcctttcgtccggccagttcccgactgaatctgcaggactgacttgcaggtaaagccgctggatttccggtgtccttgtgctgacgagggcaaacccgtcttcatgatgggcatatacaagttcaggcgaggacggaggggcttcagccaatatgccgagccatccgtaagggtacaccttttcgtactctttgcggatctccttcggaatgctttgtctgctcggcccgtgaaagccgtcgcaccctgcgatgaaatcgcagttcagttcttctgtatcgccgttttcattctgataagtgatgacaggcgcttctgtatcaatatttgaaaggcggacgtcagacacattgaaaacgatgcgcccttccgattgcaggcgggcggcggttaaatctttgatcacttcatgctggggatagatggcaatgtatttcccccccgtcagcttgtgcatatcaattctgtgccgcttgccgccaaagcgaatctcaattccttgatgaaacatagctgttttcatcatccgttcaccggcacctgtttcattcagcaaatctaccgtcatctgttctagaacgcctgcacggacggtctcttcaatctcctttcgcgagcgggattcgatcacaaccgcttcgattcccctgcggtggagcaggttagcgagcataagcccggcaggtcccgctccgataattcccacttgtgtccgcaaaatggtttcctccctttatccatgttttgatgtggcttctaatgtatacccgcgctttccgacttagagacaaaatcaaatgaagcgtgtttctcttggacgagcatgatgccgagtgcagcaaaaacactcgggatcgcgaacaccatgaaagcctgcttcggctccatgccggaagcaaggatcaatgcaaacagcgaaggcgcaatgatcgctccgagtctgccgaccccgagcgcccagccgatgccggtcgctctgatttctttcggataatactcagaaatataaggattggcgatattttgcgctccgacggtgcatgccccgcctaaggcaatcagcaagtacagaagaacggggttcatcgtcattccaaatgctgcaaaacaaaaggctccgatgacatacatagccgcaagcacttttttatggccggctttatctgccaaatatccgccgaataccgctcctgcggcttgtccgcagcaaagcgccaagttgaatgacaagcttgacgacagcccgtagcctgacgcctgcatcattttcggaagccatgtatttaagccgtaaaccatgagaaggcagctgaaaacggaaagccagaatgcgaatgtgctggctgcacgtttttgtccaaacagtttttttaccggaaagcctttcttttctttcgcaatcaccgagatttgataattgtcgtcttccctgtagcgtcccgccggatgcacctgattgagaatctcagccagcgctttcgtctttttcttcaaaacgtaaaatgacagagattcgggaaacctgctgaaaaagaacgggagcacgaagagcggcacggctccgatcagatagagcactctccagcttgtcacgggcacggcgaacatgccgacgagggaagccagcacaccgcctgcagaatagccgcaatacatagcggctacaatcaccgctctgttttttttcggcgaatactctgtcatcagcgaaatggcattcggcatcaacccgcccattccaagcgcagcgagaaaccgcatgatcgtaaacaaaagcggagaatcgatcagaccggctgctgcagtaaacaggctgaacagaaagatacagaagcccaacacctttttgcggccgtattgatctgcgatcggcgaaaaaataagcgcgccgagcatcatgccgatcaatgtatagctcccgatcgctccggcttggatggcggtcaggctccattcctccatcagccatggcaggctgacgccgtacattgcaatatcataaccgtcaaaggcaatggcgaaaaaacaccacaggaaaacagtcaggtgcactttgttaaatttgctggccgccatgacttccgctggatgaactgaacgatttttcatgttcccctccacgattcttatcgtattatgaaagcagcttaacgcacggtatctttttcattgaaagcgtgcgtgcgagctttttgtcccgccggctcgaatgccatgacgacattggagctcccggaagactgaccgtatccgtaaaacgtgcttttacatccgtcctccagcacgcccaatagcattgcaatgtggcggccgccggcttcaagcccggcgtttttagcatattgaggcagcatctgctgagctgataaaagatcgttgtctgttaagtaggtcaaaaattgtgcatcgagggcctgttcggccaatgtcggcatacattccggccccctcaccaaatgatggcttagcgccccgctgctgatgaacacggttttctttctgctttctttcagcactcttccggcaagccggccccacaaatgcgtttcttccaggttcgcggccaatgtaaccgataaatcgataaccggaatatctccctttggaacgaggtagcgcagcggaacgaccgtcccgtaatcccagcagtaagctggatcattgacaggaatgacggaaagccccccttctctgccggcttcagccaattgcagcgccaattcagtgtccccggggtaagaatacggaacatcggaaattaaattcggacactccaaagccgttaaaacgccttgatggtcgggagctgcatcgatcagatggtcaaagcttgacgtccagtgacaggaaatcaggacaacggcatcgggctcaattctttcaataatcctggagagcctcttcatgcccttgaccagctctctttggaagtcaggggttttatcttcaaaacacatcctcggtgtatgcggaacaagcgccgccaattcgattgacatgtagattcctcccatcgccttctttaaggtcttaattttgagaccggtgtgccgcctatgccccagtggcttttagaaacttcggtgacaagaacgcggacgttttccttcggagagtctagggtggcgctcaacgtttccgtcacttttcgaatgacttcctcgaccttttcaggcggccggccttctaatagttgaatatgaacaatcggcatatcataatcacctcaggttatggcttgaccgaaaatgatacatctcccagcccttctacttgtgctgaaacgcggtcgcccggctgcagcatgacagctcccgttacaccgcccgttaaaatgatgctgccagccgcaagcttttgttttttccgggagagcatgttggcgagcatggccgccgaatttgcgggatgcccgacaaccgctgctccagtgccccgctctttgacctcgccgtttatcattaaagagactcttgcttcatccagcttgaaatcgtccggcttcttcactttttcacctaacaccactcttgaagatgacgcattgtccgcgatgacgtcaggcaaagtgaatgagaaattttcatagcggctgtcaatcacttctagaacgggaatcaattcagcaacggcttcaaggacctgctcctttgtaacacccggtccttcaatatcctcccccagcacaaaagcaatctctgcttcaaccttcgggtgaatcagctcgttcatccggatgcttccgccgtttggcacgatcatatcttcaaaaatataaccgtagatcggctcctcgacgttcatctgcttcattttcgcccggctggtcagtcccattttcggaccgatgatgctattgccatcccataatttaagctgaatcagctcttcttggatcgcatacgcctcttcaacggtcagctccgggtagtcctttgtgattctttcaacttcacgcttctctgtttcggcaagatacaagagtcgcgccgtatcttttaatgctgcggtattcatccgcttccccccttttacagcttgatgcaaatattggttaattcgctgaagaattcgaggctgtgaatgcctccttctcgtccgagtccgctctgtttcatgccgccaaacggcgtccgaagatcgcggagaaaccagctgttgacccacaccatgcccgattcgatttgcccggctacgcggtgcgcccggcggaggtcgttcgtccataaggtcgcgcttaacccgtaatgtgtgtcgttagcctgtgcaatcacttcctcctcatcgtcgaacggaatcaccgttacgaccggaccgaagatttcttctttgatgagcctggaattgcgtgaaagtccggtgataatcgtcggttcaagaaagcagccggattcctgtccttcagggcgttttcctccggttaaaatattgccgccttcccgtttggccaattcgatgtagttcatcacacgctctgtgtgttcagaagaaatcaaggcgccgatattcgtgtccggatcaaaaggatcgccgactttgagctttttcgttttctcaacgaacttgttcagaaattcgtcatacgcttccctctcgacatagatgcgggagccgctcatacatacttccccctggttgacgaaactcgatttcaatgaggtgctgacggcttcatccatgtcggcatcggcaaaaataatgttcgggttcttccctcccaattcaaaggaaagtttctttaatgttttcgaagcagcttccataatgactttgccggttgtcgtttctccggtgaaagatatcgcatcgacatcgggatgctcagaaagcgcagcaccggcggaatctggtccaaatccgtggacgatattaacgactccgtcaggcatccctgcatcatggcagatttccccgagaagggtggctgtcatcggcgtcagttcagccggtttgataacggctgtatttcccgccgccaggcaaggcgccaatttccacgtcagcaaaagaagcggcaagttccacggattgatcagcccgacgacgccgaccggacggcgaatcgcataattgattgcaagatcgtcagtttgataagcttccgttccggctcctctcataaaatccgcaaagaaatgaaagttgaaagcggcacgtggaatatccaaagtgcttgagagcgaaagcggttttcccgtatccaatgtctcaagcctcgccagttcgtctttacgctcaagtatgatgtcgccgacctttctgatgatccgaatcctttcgtcagcggtcatgtttttccagcgtccgtttaatgcacgcctggctgccgcgactgcaagatcgacctcttttttgcctccttccgcaacgcttccgataatttcctgtgtagccggattgatgttgtcaaacgtgctgcctttctctgaaggaaagtacctgccgtttatgtagtgctgacagtcaaaaggttttacgagtttttccgatggagtttgaacattcatattctgcaaacatcctccttttcaaatcctttccattaaattaaaggattttaactgacaagaaaacagcaatgttcctctatgcggaacaaatcagacattttttccgaaaatttgatattttccgcttttttattttttatatcgtgttatattatggaataaaaggaaacaaaaacaagggagagagttgaggaacctatgactgttgagacgaaggaccaccagctgctcggttcagtaaaaaatgcgcttcggctgcttcaatcgtttaccttagacacaccggaaaagaaactaaccgaactcgcctcgtcgcttggcctcggaaaaagcacggtctcgcgccttttgtctacattggaaagcgaagggtttgtcatgaaggacccggaatccagaagatacaagctcggcttatcggtcctgcagttaaacaccattgtcaactccactcttgaaatcaaccgcgaatccctgccggtcctcaaacggctgaccgatgagaccggcgaaacgtcgcatatcgcgatgcgccgcggtctcagcgtcgtttatctcaatcggacggaatgcccccgcccggtcgaacttctctcatatatcgggcggcaaaacccgatgcactgcacaagctcaggtaaggtgcttctcgcctttgatgaagagggcatattggacgagtatgtgaaggaaggcttgaaaagctgtacgaaagaaaccattacagacggggacaaattgagggaggtgctgaaaaccgttaaagaaaacggatttgacgtcagttgcggggaattcatagatggtgtcacatcaatctcagctcccgtcagaaaccacgcaggtcgagtgttgtacgccgtcagtgtcgtaggccctgcaaaacgcatcaaggcccggcaggcgaaaatcatttaccaagtgaaacaagcggcccgggatatttccgaaaggatcgggtactggaaacgaatataaaaattgggggaatcagctttgtatgatcttcacacgcactttataccgcgcgatgtgctgctttggctggaagacaatgaaaagagagtccacgctgtccgcgaaaaaaaggctggatgccaagcggagtttttgacggtcaatcacaaatggggctttgaattaaaagagcttttctaccaggaggctttatatttggaagcccagcaggaggccggcgtcacacactcattggtatcgccggttccccagcttttcctttacgatctcgccgaagaaatcacggacgaattatcttttgtatacaacaaagcgcttgccgaatgggttaaaaaatacgacggccgcctctcgggactcggcacagtcccgctgaacagcccttcaaaggcgagcgagcgcctgaatgaagcgatgaacaacgggcttaaaggagcgattatcggacccggcgcttcgcaactacttctctcggacgaagcatttacaccgttttgggaaacggctgatagaagaaaagcgattatctttatacatccgctcctttctgaagatccgcggctccgccgcaggatgctgccaaacttgatcggcgttccgtgggaaacgacgatttgtgccgcagaccttttgttaagcgggtttacagaccggtttcgcaatgtgaaaattcttttggcccacggaggcggctttttgccttatcagatcggaagactgaacaaagggtatgacaaatgggccggcgtttcttcatcgctttcggctccgccgcgcgaatatttgcggaagttttggtttgatggtgtgctatgggagcaagaaagcgcggcatatttgaagaagcttgtcggagaagaccgccttgttccgggttccgattttcctttcgacctttgtcagtggccgcctctcgatcccggccggaaaggagcggagtctctgctgaatgtagcgattgaagcataaaaaaaggcgaacctcttcaggttcacctttttcaggaagcctattacagagcttgagccgccgtaatcagcgcaagattataaacgtcctcagcgttgcaccctctggacaggtcgtttacaggcatgttcagcccttgcagaatcggaccgaccgcttcaaagttgccgaggcgctgagcgattttatagccgatattccccgcttcaaggcttgggaaaacaaatacgtttgcatctcctttaatgacggagtccggcgcttttttctcagcgacagacggaacgaatgccgcgtcaaattggaattcgccgtcaagtgtaagctcaggcgctttttcttttgcgattgcaaccgcgttggctactttttcagtttcgtctgattttgccgaaccttttgttgaaaagctgagcatggcgacacgaggttcgatgtcgaacattttcgctgtgttcgcactttcgattgcgatttccgcaaggtcctggctgtcaggcgcaatgttgatcgcacagtctgcgaatacgtactgctcatcgccgcgcgccatgataaagacgcctgatgttttcttcacgccttcttttgttttaataatttgcagcgccgggcgaaccgtatccgctgttgaatgagccgcaccgctgacaaggccgtcggcaagccctttataaacaagcatcgttccaaagtagttttcgtctaaaaggatttggcgggcctgctcttccgtcgctttgcctttgcggcgttcaacgaaagcctgaacaaggtcttccatcccttcatatgtatgaggatcgtatatgtcaacgccatccagcgttaaattcaacccgtttgctttatctttgatttcctgctcgtttcctacaaggatcggctttaacacgttgtttccggccaatttgttgacagctgtaagaatacgctcgtccaaaccttccggaaatacgattttaactccttttcctgctacttttccctgcactgttgtaaatagatctgccactatataccctccttgaaagtgtcacaaatacttcatttctctattaagcatactcttttgtgatataaattcaatccttctgtattttattataacgtttacactttttaaacgctttttttaattaatttaatttcagaaaggctttaaacacttctattagtatataacagcctttcccagttatacgacagatggtcaccttttgttcaaaacttctaaacggataaaacgcggcaaactatgatatgatgaagacaagtacatacaaattgggagtgattgcaaaatgagcgaacagcaaaaaacgaatgaagccgcacaaacgcttgacggctggtatgcccttcacgatttccggacaatggactggtccgcatggaaaatgctttcaagcgatgagcgccagatcattatcagcgaatttaccggccttcttgaaaaatggggagctgcccaaaaagaaggaaacggaagccatacgctttacagcatcgtcggccagaaagcggacttcatgctgatgattttgcgccctacgatggaggaattaaatcaaatcgaactcgagttcaataaatccaaactcgctgaatacacgatacctgcttattcatacgtatccgttgtcgagctgagcaactatatgggaagcggagacggggacccttacgaaaatccgcaagtgcgggcgcgcctgtaccctgagctcccggatgccaaatatgtctgcttctatccgatggataaaagaagatcgggcgatgacaactggtacatgctgtctatggaagagagaagaaacttgatgcgcagccacggaatgatcggacgcggctatgcgggaaaagtaaaacagattattaccggctcaatcggatttgacgattatgagtggggtgtcacgctcttttcagatgatgtgcttcagttcaaaaagctcgtctatgaaatgcgctttgatgaagtaagcgcccgctacggtgaattcggttcgttctttgtcggcaaccgccttgcaaaagaacagctgcctgcatttttgcatgtgtaatgataaaaaagctccaaaggccgaggtctttggagcttttttgcctatttacttgcagttgcacggctgtgtaggcggagtcgcccgtttttgcacttcgattgaagattcggcatagaaagtcgatccgagccccagtactctgttctccgcccggaatgtatactttcctgcggcaggcagcgttttgttggccagcaccagcttaaactccgcaatgcccagcagatcaattgtaagcggcagccttaccgtttttccgttgttcaaaatttgccctgttgtcagcgctcttccattcaccgtatctttcgttgtggcggaaaatcccgacggcaaagtaaattcaaccgttcccagcgccaagattgagttaggacgatatgttaactcaatatccgagaacgaccactcctgtttgctggcgcctgttatcaccgaatacaaggaagcgctcgcagccgggcggtagacagattcagtttttgttgtttgggcgctggcctggaacgaaggcaggaaaatcgaagccatcatcacgagactaaccgccaagattgacaatttagaacgatacattcttttcaacacagcaattcccccaagtcatcatttttttcatattcgtcatgacgaaagcgtgcaagaaagatgtaaaatcaagcaacgccttctttccaaagcgccggcactttggtgatttctattaaaaactaccattttttctgcttgtagtaaatgttttccatgtcatatttttaaaataaatgcaaaataatagaatttaaccaggcgttgttcctcttgattttctccgctgtgctttagtaaaggacaaaaggcctgcccgcttcccttctcttcattctcctgattttttgttgacaaacgatggatctggctgtacattattgacattattgaagcatcacgaaccgagtttatgattgacataaccttgctttttctccattcatgttttgaatggatgaagaaaggaacgaaaaatgcctaaattggtttcttcaaatcttgtaaaaggtaagatcatcaatattagtccgccgcagacgctggctcttagtttcttgattatcattgcgatcggggcttgtttattgaagctgcctggcgcctccactacttatatctcatgggtggatgctttatttacggccacctcggcaactacggtaactggccttgttgttgtagatacaggggcagattttacagttttcggacaaaccgttattatgtgcctgattcaaatcggcgggctcggcttaatgacgtttgccgtcctcgtcgtcatgatgatcggcaaaaaaatcggcttgcagcagcggattcttgttcaagaagcatttaaccagacttctttaggcgggcttgtccgcttggtcaagcacctgtttattttcacgattgtcatagaatttgtggcgtttctgatcctttcgatcagatgggttcctgaatatggtttgcaaaaaggcttgtttcatagtttgtttaacacgatttcagcctttaacaatgcgggattttccctgtggcctgacaacttgtctcaatatgtcggcgatccgattgtcaaccttgtcatcacaggccttttcattacagggggaatcggctttaccgttctgctggatttatggacaaagcgaaacttccggaaattatcgctgcattccaagctcatgatcgttggaacattgatcatcaatacgacagccgcgttgctgattttcattttagaatactcgaatccgggtacgctcggcggactgcctttggccgacaaaatgtggggcgcttacttccaaggcgtgacaccgagaactgccggattcaatacgcttgatatcgcccagatgacaacgccgtccctcctgttaatcatcgttttgatgtttatcggagccggaagtgcgtcaacgggaagcggaattaaactgacaacgtttatcgtgatgatcttggcgacgatcacctttttaagggggaaaagcgagacggttgtgttcaaaagggcgattaagatgaaaaccattttaagagctttagccatcattgtgatcagttttttattcgtgcttttcgcattatttatattgacgatcacagagaatgccccatttttgaaaatcgtctttgaagtattttccgctttcggaacagtcggcctgtcgatgggactgacacctgatttaacggccgcaggcaaagcggttatcatgatgatgatgtttatcggccgcgtcgggcctctgactatggcgtttacgctggccaagccgaagaaggcgccgatccgccatcctgaagatgaagtgattacaggctaatatgcagaaagaccgctctattcacgagcggtctttttgtttttctctttccaacatgatgtgtcgtcatattccctcccgcccgttcatactgtaaaagggatgggaaatattgatctatcatcttgagtcagcccacagcttttcagccggatcgtcttcatagcagcactttatcattcctcatgtatagatggtaggcatgactttgacacaatgaaatgaggaggaacgagatgaaatttaaaaaaaatcagtttcagccgcttcaggagcttgagatgccggatttccggcagcaaatgggccccaatccttatccgcagatgggtcaaatgtaccagcagcagggacagcagcctttcacccaaatgggagggcagcaatcgtatcagcagcccggtccccagctgacccagccgcagccggcaggcgtccaggtccctccaatgccttcaggacagcagccttcaccgagcatcccaggcatgctgccgcttgagcaatcctacattgaaaacattttgcggctcaatcgcggaaaagtggcaaccgtatatatgacattcgaaaacaatccggaatggaatgcgaaagtctttcggggagaaattgaagcagccggccgcgaccacatcattttaagcgacagaaaaacgggcacacgctatttgctgctcatggtgtatcttgactatattacgtttgatgagccgatcacttatgattatccgtattcaatggcctcatatacaccaagataaaggttcggtttaactaagccgaaccctttttttatagatgttaagcgaagtttctcacatcattattgcgtttgaatttgtaaatgacgatgaggaaaaagacagcagcgaaagcaaacagaatcatgatattcaaatacagaccttgaagctgctgtccctcctgcaattttgccagcgtatccaacacccaccgctgcggaagaaagtccgcgattcgctgtgcgaaagacggcatgatttcaaccggccaaaaacatcccgacagcatgatcgtcggcataaaaatcaaatttcgcaataccccggatgacctggagctgtttgcaaagacgactgtgatcaatgccaggccgaccgcgctcagcgcaaagatcagcagcaccgctgccatctcccaaaatgagatgccggtttccatccggaaaacatatttcaccataatcaatgttaaaaaggtttggcatgtgatgacagacatactgacggccacattggacatgacgtactgccttgccgttatcggtgtggtcaaaagcctgaaatacgttctgttctctttttcctttactaacagttcggtcaagcttcccgctgaaaaaagcatcgccatcagaagaaaaccgaccgtccgctccgtcatgtttctatttttcgccgtgtcttcaatcgtagatgttttgacactcgtttcagaattccggtaatttttatacatttcctcaaagcgcttttcattcccctgcgccgatttgccgattgcggcgatattatcaatataatgatagacatacgatttcacgaatccggtgatttcagcgcctttgacagatgcgattgcgatgtgagccggttcgccgctctgcacgctttgagaaaagccttgttcaaacgtaatgacgcaatcaagctcccctgccgcaacttgacttttcccttctgcttcactgaccgcactgatgttgacattctcgatccccttcaaaaaatccttagtatcttcggcgattcgtccgccgtcatgattgatgattccgacgcgcaaatccgtcttttccatgcttccctctgtcaaaagcgatacgaatatgcctagcaagggcagacatacaaacagaaagatattgatcttctttttaaaagtgacattcagtgtgtttttgacaagccatagcatttctttcatcctacagcccctcccttctctgcaatgagacaacggcaatcagcagaaataacagggataagccgatgttcagcaagatggcaggcagccctgccgctaaatcgtccgcaaatatgatgttcataatagcttcgttcgtccaggcgagcggagacaggtctgtgatcaaagctaaaacaccttccgcatcgtcgacaggaaaataagcgcccccgaaaaatgcaactagcggaatcaacacgttaatgatcgccactgccgcttcccccgttctcgtcaaataactgacgccgaggccgaggcatacggcaaacaatacgatgctgaacagcacggccgctacaagcccaagatgctctccccagtacgctttaaatacgtatttgctgactgcgacgacggcaaaaatacacaatccgtttgtcacaagattgccgatcagcttacccgcaaagatctcgcctttatgaaccggtgccgcgatcagccggtcggctgtttttctaagccgctccccccttattaaatagctggcgcttaatgcactgtaaagcgcgatcagagtggtcatggcaaccgcataataatccatggagctgggctttctgtctgagctgagcgacgtctccttgatataattgtcgcccggtgcgtccccgagcacggcgcccgcttgctcaggagcagctttgatgatctccgctgcggcattgtaccggtttgcaaacgcggtcagcattccttgaataatgctgtttttcatactgtttttatccatttggtaaagcttgatgccgctgttttcgatctcaagataagcatcgtagttcccctgtttgatttcttgtttttcatccatatcggacaacacttttttaaaatgaacgccggatgttttcgcttcctttacgaatgttttaaagccttgcgaaaacgctccgtcagaattgtctttatacaaaacacgaacctcgccgaccgctgcttgttgatcgaaagcattcgtcagcgcagtgcctaaaatcataatcagtacaatcggaaatgccagcataaaaaggaacgtccgtttgtcccgaaaagcagatacaatttcttttttcgcaatgatgagtgtattcaaaccttggacctcctttctaatcgcgcaactgtcttccggtcaaggtcaggaacacggtttccaaattaggcgctttttcttccaatgaacgaatctcggccccgtttttcatcagcttttcaataatctggtttaaattattgacgcctgcatccgagttgattttgatcgtattgtcttcaagaacggccgcttccacgccgctgatcgttttcagttcgccgatatcgatattttccgcagatttaagaacgacttgaatatcttttgtgttggtaatgatcgatttcagctgctccttcgttccctcggcgataatttttccgtgatcaacgatggcgatccgagtacagatctcttcaacttcctccatataatggctcgtgtaaataatcgtgcatcccatcgcatttaactttttgacggattccaaaatataatttctcgaatgcggatcaattccaaccgtcggttcgtccatgatgatcagctttggcctgtgggcgatcgcgcaggcgatattgagccttcttttcatcccgcctgaaaaatttttcgggaagcttttatgcttatcacttaaaccgacgaactgcaatgcttcttcaacccgattgtgtaaatgggccccgcgcagaccataaagcccggcaaaaaatttcacatttgcatatgccgttaaatcttcgtaaatggccagatcctgcgggacaatgccgatgttcatcttggcgaacttgcggtgtttcgcaatgttttttccgagaatcgtgatctcgccttcattgcttctcaacaaactcgaaatcatgtgaatggtcgtactctttcccgccccgtttgcgccgagcaatccaaatatttcgccctcttcgatcgagagtgatatattgtcgacggcaacgaagtcgccgaattttttcgtcagatgatggatttccaatacattcatgttctcacctcattttgatttcattataaaaaaaagatgaatggtgcggcagtgcagcatttcatctttttcacatgagaaaattcatattcaattcatgaaatcattcatgcttgggcagcagggtggtgacagagaagccgtttgaaccgtcaacgatcacctttccgttaacagaagcggcccgttcctccatcccgatgatccccatccctttcttgattttctgccgcccttttccgttgtctttcacttcggctttaatgagcgtattcagcacatgaatacagatggatacatgtgtcgcttcagcatatttcaccgagtttgtcagcgcttcggtgatgttttcaaaaataatcttccattgaatctgagaaataacatccaaatcgcctttatgcaaaaatgaaatattcatatggtactgcgccgaacattcatcgataaacagcctcaatctgtggatgcccatctgttctgagggcggcttgacgctttttaacgtcaatctaatattttcgatcccgtccttggagatgttaatcgcattttgcaggagctctgaagctttttccttgtctatgtcaaggacgcgcttcgccgcttcgagctgaatcagcgctcctgtcatggaatgaccgattttatcgtgtatttcctgggaaagccggttgcgctcctcaagcttataagtatattcggattgtctgataaactctttgttttcacgcagcatgtttgtcagcttctgcaggtctcttctcgtttgatcaatatgatgttcaagcttttcaatccgcgctgcatcatggcttgccgcccagtacagcaaaaattgaaaagcggccgtcaacgcgtagaccgctgagatgctttcattgataaacaagaccggaacgattgaagcggcaagtaccacccacttcggcagcccaaaatcggctgctccttcacacagggtaaaaggaaggaataaaataaatagggggtgcacttctgcataagaaacgattgaaatgatgacagaaatgataataaaaagcttttttgtttttcctttaggtaaaatcgcaatcccgaggttgatacagacgtaaacaagaaggctgaacacaagccacggcagattgtcactttccgaaaaaacgcattgatagatgataaatcccaacaaaatcagtttgccggtcataatccgcaattccatggtgatcccccaggttaaaagttaactttaccggttaaataataaatcgcaatttgcgtccgatgttcaagccctgttttccccaaaatcgaggaaatataattggcaatcgtaccttcagagataaacagctccttcgaaatttctttattggacagccctctggcgatcagcgccataatcccgagctcgcgttcggtaaacaggctttcgtctatcttaggttccgcttctttatgctccgccaaattggacttaatcttgtcgaggatgatatcctgcatcacaatatggccgttgaacacacttttaatcgcgtctctgattcgctcgggttcggcatttttcagcaaatagccttttgcgccgttccgtatcgcagcgacgatgtattcgtcgtcatcaaacgttgttaagataaaaggcttggcgcccgtttctgaaatgagccgcgcagcttccactccatccatgttgggcatgcggacatcaaggagtgcaatatccacagcttgggcgcggcaaaattcgaccgcctgcaagccatcctccaccgtcgccagcacttcaaattcatcataagtgctcaatatgattttcatgccctctcttatgaatgaattgtcatccgcaatgatcactttaattttcatcgtttgaacggagaccggtcctccgccgtgcacatcccttctgttaaaatgcaaaagccgggtctttcgccctgttcataacattaaattaccatgaatcagcccctgttaaaataaaaaaagccaatccttttcagagattggcttttttagtaaaactacaaatatttgaccactgagacaacgaccatgatccatgcggcaataaacgccacgccgcccagcggagtaatcgcaccgaggacgctgatttgcgtaaggctgaggacatataaacttccagaaaataaaacgattccggcaaacatcagccaccctgccgcagaaacgcttaccgcacctgccagttttgacgcgatgagcgcgacggcaattaaaccgagcgcatgatacatatgatactggacgccggtctgccagatttgcaaatatttctcgggaattttcccttcaagaccatgggctccgaacgctcctaaagcaaccgcaagcatagcattgacagcacctaaaatcaaaaataatttcacgatcaaatcgcccgcctttcctttatcatcatagcgtacatgtcatgaatttcaacttatgcaaatctcatgacacgatattgtcatatttctttttcctaagctgtatttgttccgcagcaatcgctacgattgttccaaggacaagcccattgcttaaaatggaaacaaaaacaggatgcatcccttccaaagcactctcaggtacaaacataacccccacaccggcaaggagcgcaatcccggtaacaaagcggatgcggccggcctcgtccttttcataagaatcgaattcggcaaatgccaggccgaccatcgttgaaaacacgacgaagttcaccgcaaaaccgaccggagacggcaggctggcaaaagtattcatgaccagcgggaagaagctgatgacgattacgatcagactcccgagcaaaaacggttttttggaagacatcctcgtcgtttgaataaaccctgcagctccggatatcggcacggtccctacagctccgagcagtccgctcagcaaatggctgacagaggcgataaacccggccggacgggcccgcttcctctcttccagcttctcaaactgtttgactgctccttcaaccacccgtatgcttgcgagcatattgacgattaacaaaactgtaatgaacaacgaagtaacaaccagcccgctgtcaaacatcggcatgccgaaaggaaaaatatccggaaggtggaacagctggttcgcacgctcgggcgccttcgccacgccgaatacggcaaataagatccagccgccgaaaagcgcaattaaaattgaatattgcttgagaatcggaacgtttgaccggctcatcagaaacgtagccagcataatcacaaccgccagcaaaaacacgggtatatcgacctcgtttttccggtagccgatccccatgacacctttaacgatcggatcgctaagctggatgaccagcagcagtaaataaatgcctgtcacaacaggagtaaacatcacagccagcttatcaatgactttaaataaactaaaaataaagaagaaaaccgcgcttagcagcatcgctccctgcagcccctggagcgtttcgatgtgagtcgcgaatacggtccctgtaagaccggcataaatcgtgtagacgccccaccagaggccagccggactctcattaatcggcaggcggtgtcccaataaacattggataaaagccgttgtgccgagcacgaaaaaagtgctttgaaccacccccgcggtctctccctggttcagcccgaatgactgcccgattgcaatgggcaccacgattgcggacgcaataataaatgccgtccattgtaaagccccaaaaagcagtttcaagttgatcaacctctcttttttaaaacagacggacggcgcctagaaatcaaaaatagaatctccgttgccgtcatcttcatgcttttgtttctcttgttttttgtattgttcagcaccggcgctccccatcattttttcgagcatcagctgatcgctcgatggtttattggccgtttgaacataaggcgaagactggacggacggcccctgctgcggttccacaatgacgtcgcaaagggagcggatcaccgcgatgtgcattttcaattcgttttcctggtggcattcctttgcttttttcaattcgtcctccatcttttgcagcaaacttgatatatgtatgttcatcaaatcgatcctccaaaccgttttcagtttccatttcattttaccaaattaacttctctcatgccgaatgcacttttcaaatattccttgcgaaaaattgcctctgctgctatgaagcattgtcttttacatttcaaaaaagaatattccccggcaaaacgcgggtgaaaaaagccaattttcttccggacagaagttgacagctgaaaaggctgtcacccataatgaaaaaaacttcactcgaatttctaaaagcgaaaggaaacagggaatggcagaacgaacaacctccatcgaaacgaccgttaccgagcaaaagcaatattttttaagcggggcaacactagctgttgaaaatcgtctggaacagctcaacattctaaaagatgctgtaaaaaagaatgaacggaacatacttgaggcccttcagaaagatcttaataaatcagagcacgaagcctatatgacggaaataggcattgtactggaagaaatccgcttcatcagcagacgattaaaaaaatgggccaaaccgaaaaaggcgaaaacggccgtttcgcacatcggttcaaaaagcatcgtcattcctgagccttacggcacggttctgatcatcgcgccatggaactatccgtttcagcttgccgtctcgcccctgatcggcgcacttgctgcggggaataccgccgtcatcaaaccgtctgagcttgctcccgccgtatcaaccgttatatccgagatgatcaaagatatctttccgcccgaatatgtgtccgttattgaagggggagtgaagacaaaccaagagctcttgcggcaaaaatttgactatatcttttttacgggcagtgttcccgtaggcaaagttgtcatggaagccgcggcaaaacagcttattccagtcaccctcgagcttggcggaaaaagcccctgcatcgtgcacaaggatgctgatctcaagcttgcggctcaaaggattgttttcggaaagctgacaaacgcaggacagacttgcattgcgcctgactatctgctcgtacacaaagatgtaaaaaatgagctgatgcgcgctctgaaacaatcgatccaaacattttacggagaaaagccggaaagccatccggcttacggaaaaatcataagtaaacgtcatttcgaacggttaatccgctttttacaaaacgagaatatcgtcacaggcggaacatatcaaaaagacgcactcaaaattgctccgtccattatcgatgaacctgactgggaatcgccggtcatgcaggaagagattttcggaccgatccttcccgtcatcggctatgaaacgatcgaagacgttatccaaatggttcaaagccgccctaaaccgctcgcgctctatttgtttacgaatgaaaaaacggtacagaggcacatcctcagccggatttcatttggcggaggatgtatcaatgacacgctgatgcacacagccacaccttacctccccttcggcggcgtaggcgaaagcggaatcggaagttaccatgggtatcacagctttaagacgttttcccatgaaaaaagcgttttaaaacagacaaacctgtttgacatttcattccgttatccttcatcgaaaaacgggctgcggatcatcaaaaaacttctcaggtagacaggagccagacaaacgaagaaccgcttttttagcggttctagcgattaaagattcggaagggaccagtcaatcggctcatccccgatttgttccaaatactgattggctcttgaaaacggtctgctcccgaaaaacccgtttctagccgagaacgggctcggatgcggcgattggataataaaatgcttggatgtatcgattcgttcttttttcatttgggcatgccggccccagagaataaaaacgaccggtttgtctcttttgtttaaaacatctattatactatctgtgagctgttcccagcctttccctttatgcgaatttgcctggccccgtctcacggtcaaaacggtgttcagcagcagaacgccttgcttagcccagctgacgagagaaccgtgattcgggatgtcggcgccgatgtcattctgcaattctataaaaatatttttcaaagaaggcggtggattgacgccgggttgtacggaaaaacttaagccatgggcctgacccggaccgtgatacgggtcttggccgagaattacgactttcacattttcataggaagtataatgcaaagcattgtatatatcgttcggttcaggatatacggtgtgttcagcatactcccttttcagcatttccctcagttcttgataataaggcttatcaaactcgtccttcagctgttgccaccagctgtcattcaaaatctgtttcaatgttcaggcctccttagttcaattgtcttgcagcggtgagcctggatgcaaccggttttccatcccagacgatttcgctttccgcttccctttttttcatggcaggttcttcgagtagcacgaaaaagttctttgtcggcagcttgccaagctgatgcttttcactcaagacatccaagtaatactgcctcattccgccaagatctccggactggttgtcaccctggtctgaaaacgcatagattacgcttgcgaaaggaactcttttcacgcgaaaccgctcagccgctctcaggaaaaagtcccaatcccaataattgtggacggcaggatcgaagtagccgatttcgtcatgaagagatcgtttgtacatacttcctgaaggaacatatgtagaaaacttcctcatttcatccaagttaaaggaatacgcaaaaaggtaacggcttgtcggaattctcatatcctctttttcttcaaaagacacaatctcagcatccgaataaacaaaatcggcggtctccagcgcattcaacattctctccatatggcacggcgtgaaaaaatcatcatcatcacacagcataataacatctccggaagcttctttcacccctatatttctcgcttttacatgcttcacgttttctttcagatgtataactctgatcggaagctctgaataaaggcgctcaacaaagtcgacgctctccccggcatcattaacaataataacttcaaacggttcaacagactgttttgcaatagattcaagcaattcgcacaaagcggtgacccgattatgcgtgacaactacgatagatatgttcatgtttgtgatatacgctccttcttatttcattctaaacatattaaagcataatgcgaataatttcacatggatcaaaagatggtctggttttttatgccaatccattcacgaaattttgcagaggaccgctgcactataaagcggcagccatttcattgtgatcttgcgaaaagctgtctataataagtaataaaccaactttggatggaatctcttatcgtggaggattgactgaacatgacaatgcacaaagcactgacaatcgccggctctgactcaagcggaggcgccggcattcaggcggacttaaaaacgttccaggaaaagaacgtctatggaatgacggcccttacggttgttgtcgccatggaccctgagaacaattggaatcatcaggtgttcccagttgatacggaagtcatccgcgctcagctgtcgacgattgtggacggcatcggtgtagatgcgatgaaaacgggcatgcttccgacagttgacataattgaattggcggcagacacaattaagaagcacagcatgaaaaatgtcgtcattgatccggttatggtatgcaaaggggcaaatgaagtgctgtatcccgagcacgcaaaggctttaagagagcttttggctccgcttgccacggtcattacgccaaatctttttgaagccggccagctcagcggccttggagaaattaaaacggttgagcaaatgaaggaagcggcaaaggccatccacggcctcggcgcccaacacgtcctcattacagggggaggcaaactaaatcacgaaaaagcggtagatgtattatttgacggccgggatgcagaggtgatcgaaggagaaagaatcgacaccccatacacgcacggggcgggctgcacctactccgcggcaattacggctgagcttgccaaaggttcaaatgtaaaagaagccatttattctgcaaaagcgtttattacggaagcgattcgcgaatcgttccgtttgaatcaatacgtcgggccgacaaagcactccgctttacgactcagcggcaaataaaaaaagccccttttatgtaaaaggggcagcagattaagttcgtcacattctgtgacaacatctgcatggcctgcatcgtgcaggcccctgactacgcacattcgcatgtgcgatttatttaatgaattaacaggtgcgttttgtcttgtttagttttcaaagatcatttccgcttctgtccgaagcgactttattagtataacattttcaacgagaagtgtcaaatgtttttttgatttttcgtcgctgctgctttctgttcaaaaaccgttccgctaacagcgacgcttaataatatatcaccgttataaattagtgtcaacactttttttaataaaatatcctcggtgaaaaatcttttggccctttgtctctatcggctttactccgactaaatccttttcagccaagaactccagtataactcccaggtctgtcgtgaaatacttgagatccggatgtttaagaagttcggcaaattgccaaaccgatttttcatccatgacattgagaatataggcagcccctatttcggcttttgaatgaatgagaaaatcgcttgcgaggaataataactccagccgtttttgcaagctttcattgctttcaattaattccttatacaatttataaacctgaggttccatgtggcggacttggttccataccgtaacttcagggtgaaaacccttatcgatcacttcgattctggccaaatggtggagggcgtgtacgatggaattgtaggcatccaaaaattgaccgtcctcaaaaaacgattttccttctatatatcttctgattaatttcccgtattcaagtccgatttttagttttctttctgaaaacggaaatgtattgagctgctcaatcagcttggcgataaattcgtttcggtcgaaaagcacctttccattgagaacccagtctatgattctcctgtttgttccaagcagaatccattcctgaagctgttcaacagaaataatatgaagagaagccgtttttccgtcgaactcataatgcttcacgaatacagggtcttcagccttattaacgataatcaacaatgccgcatcaaaattatctgttgcagatgaagtttgatttctcctctcaatcagcatgacagcgagtgtgtcagggcggcttgctctttcttggtaaatcggacggagaagattttccatcaccattcctccaatacgatgtaaatacgttgcataaaagcttctctcttgtttctacctatttctacgagccaataaaaactcctttattttgaaaacacattgaattattataatcaatttccccaaaactctctatagaaattttccaattgattcgttttaattaaagaataacacatctttgatatgctatattagagacagggggatggatatggccaaatactctagtaaaatcaacaaaatcagaacgtttgcgttgagccttgtatttataggcttcattattatgtatgtcggggtcttttttaggtcctcggtcctcttgatgtcggtgtttatgatcttgggggtattgtctatcttgttgagcacagcggtttatttttggatcggcatgctttcaacgaaagcggttcaagtcgtctgtccaaactgtgaaaaaccgaccaagattttaggccgggttgatatgtgcatgcattgcagggagcctttgacattggacaaaaacctcgaaggaaaagagtttaacgaatcgtataatcgaaagtctcagtaaatgctgcaacaaaaataagctgaccgttaaaaaagcggccagctctttttaatggctttcttttttgtcgcattcctgacataaaccgtatatctccagtctatggtgactgactttaaatcctgtcacatgtgaagcaagctgctccacttcgtcgaggccgggataatgaaagtcgacgattttcccgcagcgttcgcaaattgcgtgataatgctcggaagtcacgaagtcaaaccggctggaggaatctccgtacgttaattccttaacgagccctgattccttaaaaacccgcaaattgttgtagaccgttgctacgctcatgtttggaaatttcccttccagagctttatatatatcatctgcagttggatgagacatagaattcacgagaaattccagaatggcatgacgttgaggagtaattcgcaccccggtttccttcaacgcttccaacgcttctttcaggttatgttcagccatcgtcatgcacctctcttctaaaaaaaattcttacattataacgtttataattagtgtaactcctgatcagaatctttgtcaattccaatccctgtgaaaaagctatttttaaggcgaaaaatgccgctatgatcagcatggccgatcagacaggcgaatatgagcgtaaaaagagaccaaactaaaatacagtccggcctccccagcgagctttatgcttccgcgatttcttttactgcttgaagcgcttctgcgacatggtcttttacctttactttccgccactctttcacaaggcggccttctttatcaatcaggaatgtcgaccgttcgacacccatgtattccttgccgaaattcttcttcagcttccatacgtcaaagctttcagcgagcttgtgttcatcatcgacgagcagcagaaacggcagatcgtgtttttgcttgaatttttcatgccttgcctgatcgtcggggctgactccgataatgacggcatcaagttccgcaaagctttcatgacggtctctgaaatcgcacgcttccgttgtgcatcccggcgtcatatctttcgggtaaaaatagagcacgacatactttccttcaaaatccgacagctttactttttctccgtgatcgcccagcagttcaatatcaggcaccttttgtccaatttcaacagtcattgttttgcctcctgttatgtttaatcgcttgctttcccccattataaaaaacagcgccctcttgttcaaatgttcggcggcttcttttttgcgctctgtccgcctcgtgttacaatatagaaaatatagaaatagataaaggtgcaaaaatgaggaggatattatgcagcatactcaatctgaaaagcttcatgaagaagctcttcaacatatagtcggaggcgtcaacagcccctcaaggtcttacaaagcggtcggcggaggttctcccgtcgcgatggaaaggggaagcggcgcttatttttgggatgtggacggcaacaaatacatagactaccttgccgcgtacggaccgattattacgggccacgcccacccgcatatcacgaaagcgattcaaacagctgctgagaacggggtgctttacggtacgccgacaaagcatgaagtgacatttgccaagatgcttaaggaagcgattcctgccttggataaagtgagattcgtcaattcgggaacggaagctgtgatgacgacgattcgcgtcgcccgggcctatacaggcagaacgaaaatcatcaagttcgccggctgctaccacggccattccgatcttgtgctggtggcggccggttcaggaccgtcaacgctcggcacgcctgattccgccggggttccaaaaagcatcgccaacgaggtgattaccgttcctttcaatgatatcgacagctataaagaagcgctcgataaatgggggaacgatattgcggcagtcctcgttgaaccgattgtcggaaacttcgggatcgtcgaaccgaagagcggattcctcgagcaggtcaatgaacttacgcataacgcgggagccctggtcatctacgatgaagtcattaccgctttccgctttatgtacggcggcgcccaggatcttcttggcgtcaaacctgatttgacggcgctcggcaaaatcatcggcggcggcctgccgatcggcgcctacggaggcagaaaagagattatggaacaagtcgcaccgctcggacctgcttatcaagcgggcacgatggcggggaatccggcttccatcctctctggcatcgcctgccttgaagtgctgaaagaaaaaggcacatacgaaaaacttgaccgcctcggcgccatgcttgaagaaggcatcctggcacatgccgagacccacggcatcgacatcactgtcaaccgtctaaaaggcgcgctcaccgtatacttcacgaacgaaaaagtcgaaaactatgagcaagccgaaaatacggacggagacatgttcgcggcctttttcaaactgatgcttgagcgcggaatcaatcttgcgccttcaaaatatgaagcatggtttatcaccaccgcgcacacggaagaggacattaaagatacgctcaaagccgtggatgactcatttaaacaattgaaacagcgcatgtaaaaagagagcggatccgctctcttttttatcaaatgcggagcactttgaaagcgcggtgaacaggcactttccgccggcttgtctttcttttttgtcaatgatttgttttttcttaaaaatgggttgaatatttcggaagatcgctgtatattactttattgtttggcaaattaacagagagggaatgttcactacaattcattttctgtaaagaacgaattttattatagaaagggatgcaagtacagcctaatgaaacttggtgcccgtattttcaaaacaggcattgccattacgcttgcgctttacctcgcgtcttggctcggccttccgactcctgtcttcgcgggaatcgcggctatcttcgcgatccagccttcgatctatcgttcatttttgacgattgtcgatcaagtgcaggcgaacattatcggagcagccacagccattatttttggacttatttttgaacccagtccgatcatcatcggattgacggcggtaatcgtcattacgatcaacttgaagctgaagatcgagaacacgatttcgatcgctcttgtcaccgttattgccatactggagagctccggcgacaactttttatggtttgctttggtgagaaccggaacggttattttgggcgtgttgtctgcgttcttggtcaacctgatttttctgccgcctaaatatgaaacgaagctcgtcagccatattgttgaaaatacagatgaagtcattaaatggatcagattgttgacgcggaagacaacggaacattccatgctgaaagaagacattgaaaaactgaaagaaaaaatgatgaaggttgaccacctttacttgctctacaaagaagaaagaagctatttaaaacgttccacatatgtaaaacagcgaaagctcgtgctgttcagacaggcgatcattgcatccaaccgtgcgcttgatgccctgaaaaagctgcaccggcttgaaaacgagttttatcacatgcctgaagaatttcaagaaacgctggtcgaagagctcgattatctcctccattggcacgaacgaattttaatgagattcgtcggcaggatcaaaacgcaggatcacgtcgacctgcacgaagaaggagacgtgtacaaacagcacttgaccgaatcattcctgaaaaaccaggacaaattaaaagaagaactgttggactacaatatgctgaccattatggcgagcactgtagaataccgagaacagcttgagcatttggaaaccttgctctcaagctttcagacgtaccacaaaaaagacagcgagcttgaagttgaggaagaataaaccggttaacgaatatgttaaccggttttttattttccttccttcattttcggatcaagggtgtcgcgcaggccgtctcccatcagattaaagccgagaacggtcagcatgatcgcaaatcccggaaaaaacaatgtccatggagcctgcgccaagtaaggcctggcatccgcaagcatttttccccactcggggttcggcgcctgcgcccccaaccctaaaaatccgagcgcggccgcttctataatcgcggttccaatattcagcgtcgcttgaacgataaccggggccatgctgttggggagaatgtgtttaaacatcagccttatattggacatcccgacagcacgcgctgataagatatactcctcctgcctgatgctgagcacttttgaacgaacgagcctgccaaacgtcggaacgttgatgatggcgatggcaatcagggcattttcaagagaaggccccagaatcgctacaatggcgatcgccagcagaatgctcggaaacgcgagcatgatatcaaacagccgtgaaatcaatgcatcagcccatctgccgtaaaaaccggcgatcagccctagcagcgtccccgccaaggccgatgccaaacaggagaaaaagccgacccataaagacagccttgcgccgtaaagcaccctagagaaaatatccctgccaaagtcatccgtgccaaaaaggtgttccgcagacggagcggcgagcctgtctgacagtgactggtcgtttattccgtatggtgcgatgagcggcgcgaagatggctagcaggataaacagcgcgactagaatcgtgccggcggcagccaatttatgctcaaaaaaccgccgaatatgttccgccaaaggcgaacgcaccttcacgtcctccctctgctgttcattttgaagcacaaccatgtttcccgcctcctaatatttaattctcggatcgatgacggcgtacagcagatcaacgatgaagttaatcatgacgaagatgaaggcgatcacgaggatgcccgattggataaccgggtagtcgcggtagctgatcgcatcataaatgtaccggccgatgccgggccaggcaaaaatagtctctgttaaaattgcgccgcccagtaacagtccggtttgcaggccgatgacggtcaataccggaatgaatgcattttttaaaccgtgcttatagatgacgaaaaacatatgcacgccttttgcttttgccgtgcggatataatcggactgcagcacctctatcatgctggctctcgtaattctcgcaatgatcgctgcgggaatggtggcaagagccgttcccggcagaattaaatggcggatggcttctgcaaactgatcaaatcttccgtgcaaaagggtgtccaatgtatgaatgtacgtaatggcttcgaccggatttctgacattctcccttcctgttgtcggcagccagccgagctcgatcgaaaaaaacaactggcccatcaaaccgagccaaaaaatcggcatcgacacgccgattaaagccaccagcatcgcgatatagtcgaataccgagttcttaaaccacgcgctgatgattccggcattcacgccgacaaacactgcgatcagcatcgcgaaaaaggcaagttcgagagtggcgaacaaatatggctttatttcttgcgtaatcgccgctcccgtgcggattgatgtcccgagatcccctttcagcaaatcccctatatatctggcatattgcatataccacggctgatcaaggccgagctggacggtcagctgctgcaccgcttcctttgtcgccctctggccgagaataacctgggcggggttgccgggaataaagcggatgatcgaaaaaacgaccaatgtcatgccgatgagaacggggatcagcatggccgtccgttttaaacagtacgcaagcaatggctgtcaccacctatttaaactctacgccggacaatacttcactccctgtcgggtgcggaacatatccgtcgatatcttttgaaccggccaaaatcggcgtggaatggacaagcggaacccaaggcgattcttcatggaggagctcctgcgcatcttgatacagtttatttcttttcttttgatcagggtctgactgcgcctcgattaagatgtcatgaagctcatcattgctgaagtacgtatagttgttaccgccgatattatctttatcaagcagcgtataaatgaagttgtccggatctccgttgtcgccggtccagcccattaaaaacgcatcagcttcccctttgctcaccttatccaagtacgtcgcccagtcgtaagtgacgatttccgctttgactccgattttttcaaagcttgattgaatcacttcggctattttcataccgtccggcatatacggccgcggtaccggcattgcccaaagcttcattttaaacccgtccgggtagccggcttcttttaagagttcttttgccttttttaaatcatacggatattccttaacctggtcgttgtacccttcgagcgacggaggaagcgggttttttgcagattcagcgagacctccgtagaaggagttgataatcgcctgtttatcgacagcatggttcagcgcctggcggaccagcttattgtcaaatggctttctcgtcgttgtcattccgagatacccgacgttcattgaaggcctttcaaatattttcagattggcgtctgctttgatgctttcgatatcagacggattgacgccatccattaggtcgatttcgcccgtcttcaatgcatttaagcgggctgagttttcaggaatggctctgaaaatgatcttctgcaatttcggtttgccttgatcccaatagtcttcatttttctcaaggacgatccggtcgttcggcttccattcgacaaatttgtaagggccagtgccgacggggtgctccctgaatttttcgccgtatttttcaatggcggcaggacttgcaatcccgaaagaagtcatggcaaggttctttaaaaacggcgcttgcgggcgttttaaaatgaactgaatcttatggtcgtcgagaacttttatgtctttgatgacgtgcccctcatctttcttatagcctccgaacatgccgtagtaaggaaatttttcttcatccccgttcatccaccgctcaaaattgtatttgacggcttctgcattaaaatccgttccatcatggaatttcacgccttttctcagctccaatgtgtaggtcaaaccgtcatctgaagcgtcccatttcaccgcgaggccttccttcagcgttgtgtcttgttccccgtaattcagcaaggtctcaaacatattgatcgtcactttaaacgcttcgccttctgtcgttgtgatcggatcaagcgatgtcgaatcacctcctctgccgatgatcagcgtatcttttccgccgttcgtccctccgtcgttctttccgctttcgttaccggagcatcccattaaaaaagcggaaacagacagaatcattcccaaacagatcagccagcttttctttttcatcgtacagcctccttattggtaaaatggcatgcagcataatgcccgtccgcagtctcttcaagaagcggctccgcttcaaggcagacgtccgcccgcttcatgcatcggctgtaaaaaggacagcccttttcactcatgcggggcgcggcaatatccggcgccgtatgaaccgcctctcctttgccgatgacgggtactgccgctaacagtgtttctgtataggggtgtttcggttctctaaataaagagtcggcgtccgccatctcgacaatctttccgaaatacatcacggctaccctgtcgctgatatagcggacgaccccgagatcatgcgaaataaacagaaacgttaaattgaatgcctcctgcagatcagacagcagatttaagatctgcgcctgaacggatacatcaagcgcggaaacaggctcatcggcaatgattaatttcggctttgtgatcagcgcttttgcaataccgatcctttgcctctggccgccgctgaattggtgtgcatatcggtcgccgtatgaagcatcaagaccgacaatttcaagcatcgagcgaacgacttctctcctttccgccttcgttccgagtttatgaacgatcagcggttcctccaaaatatcttttattttcatgcgcggattcaatgaagcgtacggatcttgaaaaatcatttgtatatgccttctcatgttgcgaagctgttttgcatcaaggccggtcatctcccgcccgagaaacgtcacctttccagaagtcggttcggtcagccgcagtatcgattttcccaaggttgattttccgcagccggattccccgacgatccctacgatttcgccttttttgactgacagtgtaacatcatcgaccgctttgacgattttcttgcgggacacgcggtaatacgttttcagctcttggacgttcagcagttcatgattcatgtgaaagcaccttcctcttcgtagagaaagcagcttacagcatggtcatccgccagcctgttcaatccgggctcctcctctacgcagcgttcgcgtttatgagggcacctcggcgcaaacatacagcctttttttatcgaccccggtttcggcacctgcccctcaatcgaagacagacgctcggatttgcctgtgaatgccggaatagaggcgaacaagccttttgtataggggtgtttcgggctgtcaaaaacagcggtgacaccgccttcttcaacgatccgcccggcatacatgatcatcacgcgttcacatgtattgtgaacgacgccaaggtcatgggtaataaggagaatggctgtgttaaattcggcattcatttttttcaaaagggacagaatctgagcctggatggtgacgtcgagagctgttgtcggttcatcggcaatcagcagtttcggttcgcaaattaatgccattgcgatcatgacccgctgcctcatgcctcccgacagttcgtggggatattgcttcatcagctggtccgtcctcggcaggccgacggtatccagcatttgaacggcttttcttcttgcttcttttttatgaatattggtatggctggagagtgcttctgttagttgatcgccaattgtaaaaaggggattgagggaggtcatcggctcttgaaaaaccatcgcgatgtcattgccgcgcatctgtctccattctttttcagactgcatgagaaggtctttgttttgaaacttgatccggcccgtcgtccgggtgtttgcgttcagccccattaaagccaaagaggtgacgcttttgccgcagccggactctccgacgactcccatgatttctccgggatggagatcgaaagaaacgccttgcacaatcgggatttcggactttttcttttgaaacgaaatcgataaatccgatacttcaagcaatttttcttttgtcacttatacacctccggagcttgtattttttaaattgtatttaaacgagataggaaatatgtacgaaatttgcggggaaagaaaaagcctgacatccgttcagcttcaaacgaaagtcaggctttttgcggttttagtttaatttttgaatggtgaataaatgcttatagtgcccgtcgcggctcattagttcgtcatgtgtgccgatttccgcgacacgtccgttttcgatgacaacgattttgtcagcgtgggtaatcgtcgacagtctgtgagcaacgataaaggtcgtccggtctttcgcgagcttttccatcgcttcctggatatagtgctcgctttcaaggtcaagcgctgacgtcgcttcatccaaaattaagagcggcgggttcttcaggaacaccctggcgattgatatccgctgtttttggcctccggacagcttgactcccctttctccgacctttgtatcatagccttgcggcagctccataataaaatcatgggcattcgcagcttttgccgcttcaatgatgtcttccatcgaagcttcgggattcccgatcgatatgttttcgcgtaccgattcgctgaataaaaacgtatcctggagaaccatgccgatttggtttctaaggcttcgcgcctcataatcgcgcacatcgatgccgtcgatctccaggcttccggctgagacatcgtagaatctcggaatgaggctgacaagcgtcgatttgccgcctccgctcatcccgacgagcgcaaccgtttcgccccgttcggctttcaaagaaagatcctgcaaaatcatttcctccgatttttcgtattgaaaggaaacgtttttaaattcaacaatcccttttaatcgctctgcttttacagcattgggcttatcttttaaatcatacggttcatcaataaattcaaacagcctgtccattgatgcgatcgactgcgtcaatgttgtcgaggaattgatcaggcggcgcagcgggttgtagaggcgttcgatatatccgaaaaacgccaccatcgttcctacagtaaggttcccgtgaatcacatgataacctgcaaccgtaatgatgatcagcggagcgaggtctgtaaccgtattgacgacggcaaatgttttggcattccaggccgtatggcggattgctttaccgagaaaattcccgttctcgtgatcaaattgcttttgttcataatcctcgatcgcaaaactcctgatgacaggcattccctgaaccctttcatgaagatggccctgcacttcggccagcgcttgggaacgttctctcgtcagctttctgagcctgccgtagaagaatttaacagacagtccgtaaagcggaaacagcacgatcgaaataagcgtcagcttcacgtccatcgtcatcataatggcgatggcgataaaaatcgtcatcacgtcaagccatacattcatcaatccgatgatgacgaattccttcgtctgctcgacatcattgatgacccttgaaataatttctcctgcgcgggtgttcgcataatacctgaggctcagcttttgtatatgcgcaaaaagcttgtccctgatatcataaagcaccttgcttgccgtccactgcgcgaaatactgacggtaatattcgacaggcggccgaagcaccaaaaaaatggcgaacataaccgccattaccatgaataatgtggatgttttttcctcagcagtcccgctcccctggatgatgtcgtccacgacgtatttcagcagaagcgggatgaccagcggaatagaaaatttaataataccgattaaaaccgtcaaaacgattttccatttatacggcttcacaaattccatgtaccttctgattacccccacacgtcttcccccctctatatcttgatgtgtgagtacaccgcaaaaaacctgttggcctcaacaggttttttaggattattttgtataatgcaaataccgttcataccaaatatcaataaattcagatgcaaacgggccttttctttggtgtatccaatgcagcagcgtatttaagtggtaccttaaaatgccgtcgatttccttcggataattcatcgcctttttatgatccgcgtactcatcttcatcaagaatatgatacgtcatatccgggaagacctttacatctaaatcatagtcgatgtatttgatggcttcatcgtccaaagcaaacggcgagctgatgttgcaatagtaataaatcccgtcttcacgaagcatgccgatgacgttaaaccactgctttgcatggaaataacaaatggcgggctctcgcgtcacccatgtccggccgtcagattccgtgaccattgtccggtcattggcgccgatgatgcacaattccgttgcttttaaaatcgttgtttcgttccaaatccgatgaatctgcccattgtgcttatagctatgaatttgaatggtttctccttccttgggaaagcccatgttttctcccctactttctttgcaaaagccttacaagtcagtgtgtcacatcgcctgtccgacagttcttttatttattataacgtttgaaaataaaaaatgaaaataaaagagccactcccgaacaggaatggctcttttctaaaaaacgataaagagaggctcatgcctcgattctttgataagcctgaatcacctgctccgtctgcttttggaacaaatcctgaatctgagcaagatctttccgcttctgggatatatcttcccggatcgataaaagctgggctttcttttcaagggcagccagttctttttcaattttctggcatctttcaatctccgcttgcagatacaacagcttatccataatctccatctgcccctgaaccaaattttcaaattccggcattcgggatcctccattctatgctctactccatttattgcctaagtatcatttctctatacatgccggatgtcctttgactgattctggctaagattcggaagttttgtcggaacaaaaagaaaaaagcacctcatccgatggtgaagtgctttttcctgtttcagtgattagctgttttgctgttttttttgctcagcttgttggttattttgtcttacttgctgcgcgtcagtttcgctggcaaattcagtgccgaactgaccaccttgtgcagaagcttggttttgttgtcttactttttgtgcgtttgttttggattgttggttagccattgtatatcacctccacgaccattagattgtgcaggagggtgatatcctattcattgaacgcgaaaaatttatacgagcagtgaacggccgccgtcaataatgatcgtctgtccgcggatcatgtccgctttccctgacgttaaaaattccaccgcatcgaccatgtcgctgatctctaccatgcggccggcaggcgtattttgccgggcatcttccagaagctcttcgcggttcggaaaatgcttcagggcgtctgtatcaatcgcgcctcccgaaaccgcattaacgatgatgtttttctgcgcaagctctacggcaagatatctcgtcaatgattcaagcgcagcttttgaaacgcctactgtcgtatagttttccaaataacggattgaaccgagcgagctgatgctgacaatgtggccgcctcccgttttctccatcagctttgccgcttcctgcgcgcagaatagcagagctttcgcattgatgttcatcgtccagtcccaatggctttcctcaagctccatgacagggcgcaatacgccggatgcagcattgttgacgaacacgtccagtctgccgaacgcctcctcgatttgctgaaacatatcttttattttcgccggctgtccgacattcgccttgacgaccaatgctttgacaccgagcttttcgatttcttcagccgtctcaagggccgcttttttgcttctagcatagttgatgacgatattgtagccgttttcggcaaacctcagcgctgctgctttgccgacgccgcggctgcttcctgtaataagggcacattttctttgttccatctgtcattcatctcctagtatagtgattgaaaatctgataaaaaatagctcataacacgatcaaaaaggaggcattcgccttatgtacgtaggacgcgatatgagcgagctcgaccacacgccgaaaaacgagtggaaagatgcggagcttctctattttcaccgcgccttccagcaaatcatgccatttctcaatgaagaagggcatgccgagtacctggaggttgtgaaagaaattcaagcaagaggcggactgtgccgccaggaagccgattatacgcacggcaccaccatccagtacgactaacgggcagcatgcacagtcaagctgcctatttcatatacatattccatattttctgatgcgaaaccgggaaggcgtattcagcaagctcttctttcgtgacctttttaaagtatgaatcatccggttgatcgagagttttcccgaaaaagacagaaatgttccagacaaggtgtgtaaacacatgctctacgactccttcgagcggaccgatttcagcttctattccggcctcttctttcaaaaacgccgcaagctgctcgcgctcgtacttcaggcctttctgcgtttctgtgtttgggaattcccaaaggtttgccaaaagacctgatgccggtcttttatggatatagatgtatccttcttcatcagtcaggacgacagctgcaagggtttttaccgaaggttttttctttttgcttttaaccggaagctctttttcacagccttctgcaaaagcagaacagtgctctcggaccgggcagagaaggcatgatggcgatttcggcgtacagatgacagcgcccagctccatcagcccctggttaaactcggacggtttttcctcagaaataaacgcttcgacaattttttcaaacagggttttggttttaggctttgcaatatcatcccatacggaaagaatccgtgacatgacccgcatgacatttccgtctaccgcggggaccggctgattgtaggcgatgctcagcaccgcgcctcttgtataagggccgacgccttttaagctgccgaattcctcttttgaaggagggaccacacccccgtatcgttcgtgaacttccctgacagcgctctgcaagttccgaacccttgaatagtatcccagtccttcccaggctttaagcactttttcttcgtcggcttcagcgagcgcttccacggtcggaaacttttcgataaagttgttgaagtaaggaatcaccgtgtccactctcgtctgctgaagcattacttccgacacccacaccttataagggtcgctgtctgagcgccaaggcagatcccgtttttcttgctcataccaagaaattaaatcttcttgaaattgtttgatgtttttttgctctaatttcttttgcagatccatcatgaaacttctccttgcctgtgcacgtcacatttgcataccgatcttttgttacttcggctttttgttgtaaactatatgcatatacgataacatgttacattaaaagtgaagaaagcaaaagcgttaaatatttcaggcaaggtccatcgttcgttctgtttttggaaaataaaaatgattttctagcaccattaggggaggtcaccaatggatactggcacacatgttgtcatgggcgttgcactcggaggcatcgcgacgcttgatccagttgtcggaatggacccatcaatggctcaagccgtgatgattgcgacaatcgccggatctcaggctccggatatcgataccgttttgaaattgaaaaacaacgctgtttatattaggcaccacaggggattcacccactccatccccgctgttctcgcctggtcgctgatgattccgggcattctcatgctgttttatcccgaagccaatctgcttcacctgtggctttggacccttgccgcggtcgcgcttcatgtgttcgtggatatttttaacgcatacgggacacaggcggtcagaccgttttcaaggaaatgggtagcgctcggcttgattaatacatttgatccgtttattttcgtcagccatctcatagccatcgccttttggctggcaggcgcgcatcaaggctatacatttttggctctttacatcgtcttggccggttattatctggtgaggtatttcatgcagaggaaaatcaagcatgagctccgtgaaaaaatcgatgatattgaagaaatcattatttcgcctacgatgaaattcaggcaatggcgaatcgccgtcaaagcaaaatcggctttttacgtcggacggagcatggatggaaacgtcgtgatcgtcgacacattcaacagggtgcctttaccggatacggatgtgatgaaagcggcgaaacaggataagaacatttcggcgtttctttcgttctcaccggtttacaaatgggagatcgatacgtataaggatcattacgaagtccgctttatcgatctgcgataccgcagcaaaggacactaccctttcgtggcgatcgcacacatcgacagggacacgctcgaattaatcacctcctataccggatggattttcagcgaggaaaaacttcaaaaaaaattaaagcttggctctgtttaagagccaagcttttttctccttctgctgtaccagattccgatgatgaggctgatgactgtaaccgccaaggtagctttgaagtacggcgggtaataaacgagacggatgttgttcttccctttttcgatggggattccaataaacgcgtaatttgccttttgaacggtttgcgtttttccgtttacagtgacttcccagcctttttcgtacggaaccggcagcaccatgtagcggtctccgttttgattgtcaaagctgatggacacttgattgttccgccagttcaagtcggcggccggcgtttttttggcggcggcttttttcagcaattgatagtcttcctggtgcagcctcaaatggtccaattgatatttcccttttggcagcctgattgaaattttatctgttttcggcaccctgatcgttaaatcgtaaacacctgttttgtaaatcgactggtttgactttcttgatgttacataatcattgacccgcaagttgaagaactggtcttttgcaaggctttttaaataaaatccgacataatagtcgccttcttttggaaccccgccttcgggaatgagatcgatgcctccgttttcagcggtgacgtcgaggaagccgttatgatagctcgccccctcggttttcagcttcgtctgcttcatcaaatcaggaacgctcggcggctgctcttttccgttaccgccattctcaagcacgattccttcaagcatcgcatgctcccgcgctaaaactggcgcatctgctaaagctttttccgtaaacaacgttcgcgccgtccggataaacggcaaggtgtatttgtttttataaactgtgtagtgctctgattcatccgtttgaataaacccgtacggaacattggcggcattgtctttttccgtcatgtaatacttgccgtacagcagactgtacaagttggcccggtcgcccatcgatgcgtagcggctgacgctttcccttcccatatcgatttgaaggtcttcccaataaaacagaagaagatcgcgattgagaatgcttgagtaggcgctgaagccgttaaaatcctgcatcagcggagtattgttgcggacgccgttcatccagtcgatccttgtataggggtcacccttatcgtcttttcgaatgttgttcaggaggcggcgctgttcttcgccattgtactcattgctggtcaaatagcttttcgtgacgtttttaatgccgcttgactcagacagaacatacttttgatacgtgttcgccacgaggacggacgataataaaatgcagacgtgcaaaaaaagctgcgatttcttatattgaaaccccgccgccgtaaatatggcgattgtcaggaacagaagcacaataatgctccaattttgcataagtgataaatccaagtctttccgccaaatgaccgcgatataaaccagaaggacaagcaggatagaccatatcatctctttccgcctgatgtttttcagttcggtcattcctgcggccgccgctcccccgatcgtaaaagcgagcaggtattcaaagcggttctgcggagcggagaaaccgttgaatgcgcttgccgcaagcgggctgtaatgcagaagcacaagcagcacactgattgaggcaaacagcctgaacgttttatttttatagaaggaaaatgcgaacaagaacagcataaagacagccggcagcaagacaatgcggctggaaaacagaatgttgtccgtcagatcgtatacagcgacagcctggtcatacggcggccgcaaattgtttaaaaagccgtaaactgcaggcacaaaggaaatcgcgctgattccgaaagaaatcaggcctgaagcggcgaacattctgaattgtttccacctcggcgcctccttttccgggtcaagcctgatcagccagcggaagatgatatagatcgcaatgaaaatcaagttgatataggcaaagtaaaagttattgatcagcgtcaaagaacaagcggtaataaacagtgctgtccgcttttctctgatgactttctcggctccggcgacaagcagcggcagccacagcatggcgtcgctgaaaaattcccagaacaccgtgtgcctgaaatagatgaccgatgtgccatacaaaaccgcacccgtaaaggcggcaagcttgtttttcaccataccgtttaacgcatacgctgccgctaaaatgatcaggctgagcttgatgacactgatgaatacggcggcctgcgcccaaaacaaaggatccgcatccccggccaaatgcaaaagctgcatcagaaaaacggccgcgaatgaagcgatgaagacaaaagaagtcgtgaaataatagccgagctggctgtagatgccgcccccgagaccgaaagaatacgaataaaagaagttcccttgtttgtattgctcaaaaagaaacgacttaaaaatgatcatttgtgcaagtccgtcgccgttccccgtcatatagcggtcatgcgcccattcatacagaaaaaaagaatgggcggccactgaaactgcaatgcttgcgatcacaaatagaaaaactgttttcttcatactcttcccctgtcttttttcaaaatcttccctgtcactaaaaatgtcagaggaacggttaaaaacatggaggcaagcggagctgcctcactgttcatcttgaaaaaattcacaaacgtgtagacgaacaaagaagataccgtcaaattaaagagctgtgtcagcggaaattgcaaaaactttgccagcgtcggcttgattttaaaagtaaaatagcagttcagaaaaaaggaaatcacaaggctgacgaaaaaagctgcaatatgcgaaaccatataattcaactgaagcaaaacatgcagcagcaaataaaccgcatagtaattcaaagtattcactacaccgacaacggcaaagcgaataaattcaggattcacgattttcatgagtttctccatgagcgatgtttgcctcctgtatcaagtaatgaggccgctttttcgtctcataataaatgcgcccgatgtattcgccgataattccgaggctgagaagctgaacgccgccgagaaacaggacggcggaaataatcgtaaaatagccgggaacaatcacaccgtattttaagatcctgatgaatgtggccgcgatataaataagcgatagaaaaaggataaaaataccggcgtaaaaacacattctcagcggtctgttgttgaacgacacaatcccgtcgattccatagttcaacaagtggcggaacgaccacttggattttccgtttttcctttcgacgttctcgtaataaacaatcttttggtcaaaaccgatccagcaaaacagcccttttgagaacctgttgccttcgctcagcttcagcatcgcattaacggcttttctgcttaaaagacgaaaatcgccgacgccgtcccttaaatcaacctctaccgcattgttgataaagcggtaataaagggatgacaaataggagcgcacggggttgtctccctttctgttgcgctgggctaccacttgatcatagccttcctcataccctttaataaaatcgtgcaggaggtatgtcgggtgctgcaaatccgcatccatcaccacaacagcatcgccgcgggcatgctgaaaaccggcaaggatggctgcctccttgccgaaattccgtgaaaacgaaatatatttcacatgctcgcttttttcggctagttttttaatttcctccaatgttcgatcagtgcttccatcatttatgtaataaatttcataatcataatcaatggattgaaattcgttccttaacgattcataaatcaatttaatattgcttgcttcattgtatgaaggaataatgattgaaacgaatcctttcttcacttaaaggcacctcttttggacataataaaattgcatccggcatccgcttggcaggatacttgcatctagccgcttcccacacaacaaaaggaaaactgtgggcacgctgtactattttctacaagattattttgtcattatatcagacatctatgaacaagtggtaaaaaaatgatattcctttagcttcaatcagggcaacataacaatttttccttttgcgacatttttcacataagttcaatcttccccgaaaccaaagcagccgcaagagaacttgcatcaggactgattgttaggggccaaaccccgccgccgcaatcaaatccgtttccttgatatgttcgggcaaaagggagcaagtctttgtcatcgggcgaaaaccggatctggctccgccgccggccgttttcgcatgacagcttcactttcccattccgcaaaacggcaacatgttttctgccgcccgaaggagagcttttcggctcttgctcggctctctctgcaagcggaggaaaaagctttcttctttcacagttcgttaaccggacgatttgacctcgcggcgcgaaagccgcttcattttctttatatttgctgacgcggagcgcacctgttttagtgtgcccttaccgtcctcatccagtaaggccagtgccaggcggcacagtcagacaatgcatcatttccttctaaagcaatgctcaatgaagcagcccgcgggctccggagaacagatcctggtaagaaggcttgtcattttgaaataaatgcaactggctgccgtagtgctcaatccactctttgacgactcgctctgtcagctcttttcctctgtacgggtggccggcctttgcaaatgtcgcctcgaaatccccccacagcagttcaacccatgttctggcttgtgcgtagctcagcatatgatttttttcaagaagcgcatttgtcagtttttcaaagtactcttccacttggcttttccccctttccctaaggaaaaaactttctttttgaaaacgtcgtccttttcatatactaaccttacgtcttccgaaccgaagacgcaaatattttggacttgattggaggagcctaaaaagagatgcgaaataaatcaagaggctttccgaacatgaacaacaataaatttgaaggcgagccccgggccaaagatgattttgcttcaaagcgccctgacggaagcacaaatactcatcctcaagaaagaatgagggcttccggcaaacgctaaacttttctgggatggagtgatttctgttgtgtgcaaatcgcaaaccgtatacaaacgattttaaccagatgaaaacgcaaaactatccgcagccatgggcaaacacaaagcatgcgcgcgcgcaggtgaacggagaaacgcagcagactcaggatctcatcattctccagcgcaacacgcgcatccggacaagatagcagttatgaaaagggtttaggctttttgtcttagcccttttcttttaataaagaaattggcagagcctcttcatgatccggtgacgaaagacggtatccccaggcgaatacgccgtttaaatagcggatatggaaatcgtcgcccccatcttcgatttcgtatacgttgccggctttaaaatcggccggatcaagaaggtaggctttcgccatcgcgattttccgttcgtgaacggccagttcattcacaatccccatttgttctgcttttcttgccttttcggtcagacccgcaatttcctggtgcagttcgtgtgcagtcatttcactgtatcttttctccatcttctcatcccttttcatctaaaaattggtcaatcaagtcaattgaaaatccttttctaaacagatactgtttgaccttcattttcgtttcgtatgatccgtcataaccgtacctcttcattgctttttctccttgcttctcaagcgcttctctctcagcgccatcgtcgttttcgtaatcggtttcctgaagcgcggccgaaatgacatcgaaggagaaaccctttctgacaaggtgctgttcgatggcctgcttcgtctctttggaggacagctttttttcttttttcagtactttttccgcatgcttgaccgcggcctcgacctgatcggaaaacgaaaacgaactgagcgcttcatgaatcagttcatcatcgatccctttcaatttaagctctctgaataagacatcagggcctttgccgctcgtttttctgtgggtgctgacatatgcagccgcaaattcgcggtcgtccaaatatttataacctttaagcatatgcagaatttctgtgatcgcggagtctgcgacgccttttttcttaagatggtcttgaacttcctttgtcgagcgcatccggtatgacaaataatcgagcgcttttttgaacccttttttaacgtcgtctccgtattgaatctcaatgatatcaagctcatcaagctctttgccttttcgcaggtcaaacttgacgagcacgtccaggtcgacgctgaacgcatatttttcatccagaaaaatattgacccgctcttcattgtttttctgggcagaaatctttgtaatatatggcataaataactcccttcttttgttttcttcttttacaataaggttaatgatcatgaaagggaggaatcatgatgaagattgcgattgccggggggacaggttttatcggcagacatttgacaaacgccttaaccgcccggggacatcacgtctatattttaacaagaaaaccggccgaaaccgaacaaaaaaacacttctttcgttctctggcaaaaaaacggcgcccgtcctgaaaaagatctgaccgatatcgatgtttggatcaatttagccggaaaatcgcttttcggccgttggaatgaaaaaacgaaggcggagatcgcgacaagccgcctccgctctgtggaggagtcggcccgcatcatacaaagtcttcagaagaagccgaacaccctcattcaggcgagcgcagtcggaatttacggaaccagtcttgaacagacattcacggaggaatctccagtttcggctgaggattttttaagcagaacgacagctttgtgggaacaggcagccgaaccaatcgaagcgcttggcatccgcaccgtctggatgcgttttggccttgtgcttggaaaagacggaggcgcgctcccgaaaatggcgctcccctatcaattgtttgcaggcggacgcatcggctcggggcggcaatgggtgccatggattcatatcgaagacgccgtcggcatgattttatctgcgattgaacagacgctgatgtccggccccgtcaatgtcacggcaccgaatcccgttcagatggatacattcgggcaaaccgtcgcgaaagtagaaaaacgcccacactggctcccggttcccgaatttgcgataaaaggcgtacttggagaaatgagcatgctcgtgctgaaaggacagcgcgtcctcccgaaaaaagcgcttcagaacggctatcatttcttatatcccgatctggaagatgccctgcacaaccttctggcataaaaggcgttttccggcaaaatccttgtagcttttcctttcccagctgcgtaaaatgtaagtatctttttagcagcatacacgtacagggaaggcaaatggtgcgccaccagatctctggttttagtgggttcgattcccaccccgaattttttaatggatgtgcaagatacgcggacaactgcttccgctaattaaaaaattccgagggtggattcacgcgtcccgttctgctgtaaaagccgccctcaaactaaggaggggctgctatgctgaagaaacgggaactgaccgactgctatgcactttttgaactgatgattcatccggatgtcttcccttttgtcagaaataaagcggagacgattgaagagtatatgtttcatgtcaaaaacatgattgaagaggaagaacagggaaagctgatatcgcgaacaatacttgatgaatgggaaaacccgatcggctgcatcagcttgtatgaaatcgaagagcaaaaaggcttcctcggcacatggctcggcaagccttaccatggaaaaggctataaccagcgggcgaaagacgcgtttttttgcgagcttttttatgaaaagcaaattgaagccgtttttatgaaaatcagaaaaacaaatatgcgctccctcaaagccgcggaaaagctcccatatgccgtcaagactgatcttgactgggccggcagcgatacatttcacctgtatgaaatcccgaaagatttgtacacgctgtacagcatgagaacattcgaggaggaaaacagccggttaaaagaagcttaaaacttgtataaatgccgcggaaacggacagcctgtgaataacttaggtttttaggaggcttaaaagatggctgacaagaaaaaacgcgaacgttttaaatccactctgaacaagacgcaggaagtcagatattcgcgcgaatttaaaatggcagagcgcgccgcaagggaaaaatcgtaatgcatagcgggagcctgatcagcgaacaataaggcttgaccggccgattattgatgaggagtgatcatatgggcagaaatgcaatccacaaaaaccgggataaaaacaagcaaaaactccctcaagttcctgatcagtataagcgagaagctgacggagtgtatgaggaatattcagcagaactcgccgatcaggatgaccgcgaagcacaagcccgcatgcaggcagctgataagcgcgcgaaaaagcggcagtcaaaataataatcgaggcccgggattcgacgttccgggcctcattctttaagttaattcggtaaaaagctgtgcggccggcgtcctgtgcttcgcttcaggaatttccgcaggatatccgatctgcaagagagctgctacctgctcatcgcgcttcagtcccattaacctgtgcagtgtttcatgagagagaacttccccgcttttccataccatgccgatgcctttttcccaagcgagcagctgcagattttggattaaacagctgacggctgcaaaatcatcccgtctgacccgttcgttttcgtcttctttcataataacgaagagaaaagccggaacgctgagaatatgctccctgaacttattgatttgttcttcctgcatattcggcttgagctctttaaacgccgcttttaaattgtcggcatgcttctttttcccgttttccgtcccgatataaatgaatcgccacggttctgtcagcttgtggttcggagcataaatcgcatcttccaagagttccagcaccacttccttcggcaccggatcctgtttaaactttcgaatcgttcttctatttctgacgcaatcgcgaatactttggatttctagcgtgtcgttcatgtggccgcccccttaatgaaaatgattatcattgttgattataatgttaactgctggcgtttgcaatgatctccactcgctaaaaaaggcggtgtttgtttacacttcaaagctttgcttttcagcaaatacagcggttcctgtcatgcgcactttcatgatgccgttttgttccgcaacttcgattttcacttttccgtctttccccatttcctggccctgttcgatctgaaaatcagtctggccctcttcacagaattcctttccgaacgttttcatataagcgcccatcactcctgatgccgttcctgtgacaggatcttcgctcgttccggaataaggcgatgaaaaatgcctgccgtgaagctggcaatcccgatggatcgtctccaggcaaaacgggtggacagatgctcgcggcatctcggttaaaacgttcggaaattcagcttgaacgggcttcatcctgcggattgcggccaaatctctcaccggcacaagcaatgtccatatacctgtgcttccataaacaacgggcaatgcttcatgaaagtccgcttcgctgatccccagcgcttccgccaattggcttctgcttcctgtgaaagactgaaaacacgggggcgcctgctccagcgtcaccaaaaaacgccgattgccgtctgaggcggtatacacagaaaggacgcccgcttttgtttcgaccttcagctccgcgccagcttcaatcgcgcctttttccaaaagcgcataaagagaagcaacagtcgcatgtccgcataaattcatttcatggcccggcgtaaagtagcggatccttatgtcggccgactcgctcggcagcaggaaagccgtttcattatagcctgcctgttcagcgatcttctgcatctcccaatcggtcaacccgtctgcttcaagcacgatgcccgccggatttccttgacccgcagtctttgaaaatgcgtcatatcttaatacttcaattggcttcattttgatcccccatttgtcgattcgatccttcccttccaatcatttgcagtataccgccttttgagtgcttcttacaatggcaatataaaaaaaaggccgttttaataaacggcctcatttcgttctccttccgatcagccttgtcacaaggatcatcgttaccgggagagatcggtttttccgataggctaaatatttcccccgccaaaccggcttatatttttctttaaaagaccgcagtccgctgaaactgtacatgtagctgacattgttgaaaatcacggcggccagccgctccgtccagaatgactgaaacgttgtccctacattcgataaaggggccattcccatattgaaggccgtgtagccctgttcttttccccattgaaataaatagatgaacagcgcatccatgattcctttcggcgcctttttcgaatagcgcatcagatcgatggatatttccccttcgcggtacatcggcatgatattcataaacgcgacgatctcgccttcttcgctttttaaaacggcaattggcgccttttgcaaataatcttcttgaaaaaacccgagcgaaaagcctttttcttttttgcggccgagccattcatcagacacctgcctcagctcgttgaggaattctctcgaaaacggcggctgttcgacatggaacgtatacccttcccgttcaaaacggttgtagatcgcccttagtccggcccgcttttttccgctgattgtaaaggtgtcaaggtcgacaatcgcctcttctccaagcttgaaaaagcggtatccgaagtcatgatagagcgccatgtcttcgcgttcgatctgatagaaaatgacaagataccctttttggtcagccgcatgaaggaattctttgatcacgagcggaaacgagtcttcccggccggacgggtcgccgagcacaacgaggcgctggccgactttggcgaattgaatcagcgcattcccgtcgcttgaataaaaaaaccgcttgtcccctaaaaagcctaaatggctcaaagcgttgccgcctttttcttctaagaatgcctccagtttctccggatcaggctcttcaccgatctctttcgttttcctgttaaacgcccagatgaaaacagcgaaatacagcggaacgaaaaataacgcaaaaaacgtcgcgaagtcgacatggcgttcactgtgaatgaaataatctttcacaagaagatggccgagcgcctcccaaatgtgtgaagcgataatattgtaattcaataaagtaaagaggaagataaaagctccccatgcgatttgcccgaatgtgtagacagcccgctcccttgtaaactgccccctcagcaatacaaacagggcaaacaccacaggaatcatgaagacggcgctaatattaaagcctttaaaaagcgtgaacagaaaggcaagcgccaaagcggtcagcgtcatataataagatctctttgtcctccgataaagttcaagcggcagaatcagcaaaatcaagccgaaactgagggacaaaccgttaaaaaacaccagcatgaacttcgaaatattcggtatcaatgtaatcctgtcaatcggcagcgccacagatgcgatcacaatcgctccgctgcaaaatgcgatgactgaaagcgaaccgttcagcagtctgaataggagcgctctgtgtaaaatcaacagaatattggtcgtttctattgccggggcaataatcggtttttcttcgagcctcttcatcgtatttccagtcaaatcggctgctgcaaaaataagaccgaacacaaaagggataaacgaataggcgatccggtagagcacaatcgccgtcagagtgatttcctgatcaacccccagctggctcattccgaccaaaaaaagcaggtcgaacgaaccgaatccgccgggaacgagactgatcattccggccaccgaagcaatcgtaaaaacgccgatgacggtttttaagtccaattcgacgcccatcgttgcaagggaataatacatgaccgctgctgcggcaacccactcgatcaccgatgcacccagataagaaaagaagaccgaaagccgcatgcccttttcggctcctctgcttctcttctttttgatcattaaaatgacggccgcaccgggagcgatcatcgccgtaccggcaacagccagcagcacccacgttttttctgtaaacagatccccggcaggcagaattccggcaaggacgagaaggctgaggacagacagcccgagaagaaccgaagacgcaagccaagcgatccccctgatcagcttcttcacatcatcaacatgctctttgtaaaggatcgttctcaatcctgcaccggacaatccgccgaacccgagaacattgttaagtgagttggcgatccatgatactttgatcgttttccatttcgaaaccttcattccgagggagcggaccagaacaaaatcgtataatgtcatcgccaaaatggcggcaagtccgagaaaaacaaggatgaataggtcaatccgattaatttgatcgataatcaaaaatgtttctttaaaagacagcccggccagttcttttttcgcttgaaaaaagacaaacaaaagaacagccgccggaatcacgatccttaaaatcgccagcgcattttttttcatgaaaaaccacttctctctaatctaatcgcaagataaatccatcacgttttgggtgataactcatatatcttaccttaatttaccggctagaaaaagcaataaccaacgattccgctgttatgttattgttaacaatcccctctgaaaacaaacggcaaacaaaaaacgcgcccgcggcgcgtttttttcaattccagcccattctttttcgatgcgctttaatatgggcaatatggtgttgtgagtgccacacatagagagcaagcgcttgatacagcttcatctcctcacctgtgccaggataaatgtacgctttttcaaaatccgcttctgtcaaagattcaaaaaagagcagcccagcgcagatgcagcgtgtctaaaagcgccagcgacaaatccggatccagcgttctggcatcggtaagcccggcccaattctgttcgtcaaacgtgcggatcaaaggcgtctcttctgtcagcgccaatttgcttcgaatatacccgttcatatggctgtcggcaagatggtgaacgacttggaggacagcccagcctccggtccggtacggcgtatcaagctgttcttcatttagtcccgccgccgcgcttctcaggagatgcggcgcttgcttcagatccccgatccatttttccagttccctttcgtccgcttcaagcggtttggaaaaggtgccgatcggatatttcaactgatccattgtctgttcctcccttagtcgcaatacacttcatcatgtttttcaaaaagatattcgatctgttcataggtattccttgctgccgataattcaggcagattctccaatgagaaaaaaacaaggttttgtgtttcagtccccgcttccgccttgcctccgacaatttgacaggagataaacagcttatagatgtggaaggcggaaggggggtggttgtggcgctttttatccatgaccgccagaagtttatgcgccttgactttcaaacctgtctcttcaagcgtttctttaaccgcgatttctttcggcgtaaagccgatgtctgcccatccgcctggcagcgcccatttgccgtctgctttttcctggacaaggaggagcttatgatctttaaaaattacggctctcacatcgactttaggcgtttgatagcccgattccccggcaaaaagctctttcactttagagaagtccgtttccgtataatcggcgatgatttcgcagctcagctcgcgaagctgctcaaaacgttcacgatcaaagtcatcttttgtataggcaagccccgcctgggcgatagcttgaatttcctttgcccaatccagccacttcatctcctttgtcatttgctgatcccccgatctgcaggagctatagaccggtagacacggtcaagccattgcgtgcgtttttcttcagagctgtctttcacgccggcaaacagcaggcgctttacccgccgtacgccgcaaaacttcaacatcacatctttaaccgtcacccagtcggcatcccgctgccaaaaccgcaaataccaagacggagcgtcagccgtgtagtaaactgatgccgtgcgcgccttcagcaggccttttggcagctttccttgatatgtataggcttctccggcggcaaaaacgcggtcaataaagcctttcatgatcgctggcattccgccccaccaaagcggataaatgaaaatcagatggtcggcgtttttgacaattcttcgatattcggcagtttccggatcgcgtttcatatctgagcgccttttcttttcatcaaataatagaacgggatcaaaccggtctctatacaaatcaatgacgtcataaaaatgcttaccgtcctcaagcgcctttatgacttgatttaaaatggctccgttgaaactgtttggatttgggtgtgcatatataacggcagtctgcatatcgcttcctccttttcgtcctatgatggaattatattgtttattttgcagaatttaaagaaaatgaacttggagcgaatacgatgaaaaaccctttccttttcaaaaaaatggaaagggttttctgtttagtttgcttttttcagatcttcattcagttctttcatgatctttccgccgccatgcttctcccatttcaggactgcctggtcaaagctttttcattgatttccccgagaataaattgaaatgtggcgtcatcaatgattttcttcaattctgttcccctgtccatctgtgcggcagaatacagcggttcggccggattctggactgcgattgcccggttgtcctcctcaagcttttcatttttggcgcggagcggatcttcagcgctttttaaagcttgtttattgacgccaatcagctggtttaacggctgaatttccgcttcccacagatggtagttttcctgctttcgaaaatagccgctcccccctttcttttcatagtgtacgccttctattccatacaacatcaaattgttgaggtcttcttcagcgattctgtcaaaaaatgcgaggatttttctgacctctttttcagtcttgacgcttgatttcgaaatggcgaacatcccgccatgcccgccgagcgcccatgtgcgctccttgccgtcggggcctttgatccggtttgcgatatcaagctgaaagccggggttcaaagcgagtccctgatcacgcaagttcatggcatcgctcatcgcgccgatatagattcccgctttcccctgaatcactaaatcctgctgctgcgttttgcttgtcaccgcaaagtccctgttcatcaggccttcttcataaagctttttcatgtatgccattgcgtctttataggcctcatgcttaaaataggggaagagatttccgtcttcgtccgttccccattcgttcggcgcgccaaagtacgaagccagggttttaaacgctccgaaggtgagatcattgcggtcggcgagaccgaacgtgtcgtcttttccgttttgatcggggtcctgttctgtaaatgctttcgctattttataaaggtcatcaacggtttccggcatttccaatccgagattgtcgagccagtctttccgaatcacgactccctgcctggccatcggcctttctctataaatcccgtaaactttgccatcaaccgaaatatttttcaatatagttttatcaagttttcttaaattcggatagtctttgaaatacggtccgatttcccagaacattcccgagcgcagcgcgctgacaaccgctgaatcttcaagatcaggcaatgtcattactttaggcatgtttccgcttgcaagggttgtattgatccgctcttcttttgttgaatccggaacccagatgagcttcagctttgtattcgttttgtcttcaatgatgtcaagcgccttctctttcggaggctgcggtgtgtggagcggtacgagccaattgatttcaagcgccccgtcctcttccgttgatgccttttgctgagtacagcccgcggaaaaaaccaagaccaagatcaggcaacataactttttcatacgatccctcccgtttgttaagaaaacgctctcaaggaggaatgcccgacatgctccatcctaaatatttcatagccgagcattctttttcgattcaatatatgcagagaaaaggatttaccgagatgaacgcgccgcatgttcatgaaggctatgaactgtattatctgctgagcggagaacgcacgtattttattaaccaaagcgtctataccgcggaaaaaggcacgatgatcatcatcaatccccacgacctccaccgaacgtcaagcacggaagttcaagagttcgaacgcatcctgattaatttctcgcacgatttcatagaaccattgctgaagtgcagccattatcggcttcttccgtttccggaaaatcaaaacttcatcgcattttccctgcgtgaacaggccgcagtcgaacatatgctgatggagatgaaaaaggagtgcaagctgaaaaaagaaggacacgaggatgtcgtcagggcgctgctgtttcagctgcttttcaccatttaccggagccttgcgggcggcggccgcaatcaaacacggccgcttcacccgatggatgaaaaaatctcggaaatcgcttcatatatcaattgcagctttcaagaaacgatgacgttagacggattggccggacaattttatatcagcccatcctatttaagcagagtgtttaaaaaagtgaccggctttcatcttcaggagtatatccggcacatcaggatccgcgaagcgaaaaaacggcttcgtgatacagacgagaaaatattggacatcgctgcggataccggttttaagcatatcagccatttcaataaagtgtttaaagagatcgtcggcatcccgccgcttcaatacaggaaaaaaagcagagacatttaatatgcaatatagcggaaccagtcaaaatcagcggcagcctttctgccgcttccgccgttattggcgaatatcccgaccatcgttcccgtatgtccctttgcgtcacgcgaaccctcatcgcttaaaaaactggcgtcctctgtaccgcccgcgtggtgccaatgcttcccttcataactgtagtaaaaatccctcttttgcttattgatgacagctttcagaaacagcgggccggcctcggcatgttttttccccagcgttttttggcaaccggagcgattttccacgaccttgatcttcaatccttcttcatagatcaagcagcatttcaaataattattcgtgctgtagtagcagacgatccccgcttgctctccggacgccgaaggtgaaaagtcgagtttcacgccggcgctgtataggtggtgcttttcccttctgacgaccgtattttttgcacggatgtcatgtaaatcccaatcacctgtccacagcctgagatatcccggtctctcggtcaaagaccagccggaatgatcgggattcctgacaaactgccagtcaagaccgagcgtatcctcgtcaaaatcgtcgaaattcttttcatcccatttgacttgggggaggtttggagcgcgctgaacaagactcgggcccttcaggctgttgatgacaaaccagccgtcatccgtccattcgacgggatccaaagcggtctccctcccaaccgttgtatagctaccttgattgggccgtccgcatagatacaccgcccaccattctccattctgggtttcaacgagcttgccgtgtcctgctctttgaatcggagcatccgggtctgtctgcgttaaaatcggattatacgggcagggctcataaggaccgtacaaatgcgttgagcgggctgtcgtaatcgagtgggaatatccggtgcctccttctgccaatatcgcgtagtaataaccgtcttttttcagcaaatgcggcccttcaggcgcccttctcccagtcccttcccatatctgaaccggctcgccggagatgtctgtgcattcttcatttagaggaaagagcgtgcaggcaggactgagcagcatatagtgtttcccgtcgccgtcaacgaagtgagaaggatcgatgccgctgccttcatcaatgaaaacgggctttgaataaggcccttcggggcggctggacttgatcataatctgcctgcggatcagctttcggccgttgacgacagtcggtccgttcagcctgtgcgtcgcgaagatgtagaaggttccgttatgatacgaaatatcaggcgcccaaatgccgtgcgaatcattgatatccgacaggtccaatccttcattttccgtgattccgtggccgatgatcttccaatggactaaatctttagagtgggaaataacgattgccgggaaatactggaacgttgagttcaccatgtaataatcttccccgactctgataattgaagggtccggatgaaaaccggtcaacaccgggttcgtatatgtgtgttcaccgctcatggcattcccctcctgccggttcgacactgaaccattcgatatcgcaccatccgtcctgtccgtcttctccgccggtatcggcgcaatatacacctgctttggcacccgtccacagtccgggaacagcctgaaacgaattcccaatctgtgtgaaatgacgccggtccatgctgcagctgaaacggcagaccgcctgttcatcaacagtcacgcgcaaatagaccatttccgcatgtacgccgcgctcttctgttttgacatcttcctgatcaccttctatacggccttcgtatacagaaagccgataaccgttttctgatttcgagaagccgagataggcgtattcccttcccatgacagccaagccggccatcatagtttccgacaaggcgtttagcgacaatttgaccgttgctgtgaagcttggccccgaaaatttctgcatcagaaggttcggcaggcggctcagtttgaacggatgagcgatgccgcggctgtataagcgaagccggccgggactggcgctgagagagtaccattcttgcttcggattcgcttcccattgccaatgaagcgcaaggcggtctgaagaagaaaaatcatcattgccatgatcaaagggcagtttcacttctttggcgcccgtcttcggcttttcccaatgcaaaaccggttctccgatcccgtcgccgtttatgtcttcacccatcagcggccagccgtcgaaccagcggacaggttgaagttgcacaactctgccgaatgctccgcgatcttgaaagtggataaaccatgactctccggaatcaagttcaacccagcctccctggtgcggaccgttaatgaccgtatttccttggtgaaggacaaccttgtcttcatagggaccgtaaatctgcttgctccgcaaaaccgtctgccagcctgtcttcacccctcccgccggagcaaagatataataatagccgtcttttttatacaatttcggtccttcaatcgtagggtggttcagcgtgccgtcaaagacgatttctccatcgtcttccaaagccgttccgtcttttttcattcggcaaagattcagcttgctcttgatcccgattctgctgtttgcgtaagcatggatcagataggcatttccatcgtcatcccaaaatggacaaggatcaatccagccctttgtctttttgacctgtatgagaggctcccatcctttaaacggatctgatgttttgctcatgaagattccttcatcaggcgttgcgaaatacacccagaattctccgttatggtatcgaatgctcggcgcccacgctcctttgccatgagcaggggcctcatattcgccgaaggggagctcgtcaaacacatggctgatcaatgaccagttcaccaaatctgtcgagtgcaaaatgggaattccgggaaaacaggaaaaacttgaagccgccttaaaaaagtcgctgcctttccgaatgacatccggatctgagtagtccatgaaaagaacgggattgcaaaaccgcccgccgtcaatgttcggattccagacaggcggatgatgtttcgccttgccagtcaggctttttgccatcaaccttcacccctcatttccagattttcaaattcatgttagcatagctgctgcccctgaatctttgttattaatgtctgtttcttctcattctttgctttttttgttgtcctttgattgaatggcataaaaaaaggcgaaactggagtttcgccttttcaaacggtcaatctgatatcaatacctgatgccgggtctttaacaaaccatgcgttttcttcatgctcaacggcataacccgagcttttcagtttttttgcaattcggtcaagttccgctcgattcggtaaaagaaccgtgtaatacgccatgcctgccgcatcaagcggggcaaatggcgcatgctgtccggcccagatgtttaagccgatatgatgatggtagcctccggcagagacaaaaagcgctgacatgtgttgataatctcctgtgatatcaaatcccagtacagagtggtaaaattctttcgcctgcttcaaatcccggacgtgaaaatggacgtgtccgatttttgtttccgggggaagaccttgccattcgtggccatcggcttcttccagaagtccttggacatcaaccggctccgtacccatcacgtagttcccctgctcatctcgcttccatccctctcgcggacggtcgcggtagatttcgattccattttgatcaggatctgacaagtaaaacgcctcgctgacaaggtgatctccctggccgagttcaatgccggcgcggatcaaatgcttcacagccatgccgagctgctttcggtttggaagcaaaatggcaaaatgataaaggcctgctgccgatcgttcaggaagaacaacagcatttggaatctcctcaatgatcaaaagcggattttttccgtcaactgtgaactccgccgttttgccgtcctgttttaatacttgaaaaccgatcacatccctgtaaaaagaaaccgatctttcaagacggctcaccttcagcttgacatatccgagctcagtgcccgggtggatttgctgcgtcatctgtttttccttctttccttgatttcaggatcatttccccaagggacagcatgctgcttccgctcaaggccaagtatacagacattgcaagaagcgtaacgtcaaattcatagcctgcgcctccatccgttcccatgaaaccggcggagagcttaacagtgaaaatggcccccagcatgacaatcgcaaataaaaggccaatcacacgtgtaccgagcccgagaatcatcaaagcccctccggccaattcgataatcgctacgatataggcgagaaagcccggaattccgacactgctgaagaatcctacagtattttcaatcccgccttgaaattttgaaagcccgtgaagcaaaaatgtaagacctgtaaccaaacgtaaaattaatgcacctaattcgtatttgttgctcattattttctcctcttgttcaatttttattttaaagaccaatgacgaacgccaactttatccatctatcaacatatccccttgaataagtctgcagtgtcctccttttttcgttcgttacttactttgtgtaagttagtatatataaataacaaacttacgtcaagacattttatgagctttgctcattcattgatataccgttataatagacctagagaggtgaggaacatgagcctatcatctttatgtccgaaatttgaaaaaggaatgaaaatgataagtcagcgctggaacggattcatcattcaccagcttcttaacggcccgcagcggttttgccatatagaatcttcccttcccatcagcggaaggctgttatccgaaagattaaaagaactcgaacacgagggcatcatccaccggcatgtgtatccagaaactccggtgcggatcgaatactccctgactgaaaaagggcaggcgctcgaaccggtccttaaaggaatggaaaaatggtcgcaggaatggatcgatctggacgaagccaatgaacgggaaaatcattaaaaaaggcgtgcatctcaggtgcatcgcctttttgttttgctgattaattccgcatattttcaagctgcccccagccccccgtctttttaacgcttgcctgaacatcaatttttaatcctcatatattaaatagggaaagatgacgaagatgtcttgagaggagaaagaaatgcggagatgcttgaaaatattagttctgattaaaacgttttggaagaccatgcccaaacatgaagtaaagtataaaatgatgaaatctcttgaggagtttgccgaagtcatgtactggcatacggacggctatcttccggatatattggacaaaatccaatttcgtcctgatttcattttccactacgacattgcctacggcttctcattgtccccaaacattagggggctcaaagatacaaacatccccaccggcgcgtttgtgatcgattctcattttaataaacagatcagaagcagctatttcgaagacaaccaaattgatttaattttttcagtgacaaaagagcattttttaaatgaatacccccagtacaaagacaaattcagatgggttccatgggcagttgatccagaaatattcaaggactggaagttgaagaaaacgatagactatttgctcatggggcttgtacatgaaggaaacaaaagatatcccccaaaaggaaaatacctttttagggaggctgtattgcagaccatgaagcatgaagaagggtttgttcaccacccccatcccggcaatgtcataactgacgaagaagaaatcaagcaggcttttttgaatgaaaaatatgcccaggaattgaacagagcaaagatatttttcacatgcggaagcgccctccgctacccgttgttaaaattttatgaagcccctgcctgcagaacgctgttgctggcggagccaaatcaagatattttcgatcttggctttaaagacggcacccatttcattgcttgtgaagttgaagacttttatgacaaagcaaaatactatcttcaaaataaaaaagaaaggcagcgtatcacagacaacggctaccgtctcgttcattcacagcatacctatcatgcgcgtgcacaagaaatagtagacacaataatagattttttagagcagcaggaacaatgatgaatagatctatttttcttatcggctggattcttcccgcacgcattttctttccggacatatatttctattactgatgatttaaaagatttcgaggtgaaaaacatgggaacggaaatgccagctgaattttatgatcaatttattgaccgacatctgattccgcttgaaaaaagcccgtggagaaaggtgtatgaagaagctgcacgtttattgccggagtccaaagatgaaacgattgtcgatatcggctgcggcactgggagattcgcaaagcttttatatgacaaaggatacagaaaatatttaggcatcgatttttccaaaggaatgcttgaagaagccaaaaggtataatccctcgtttactttcatcgaaggaaatgtatatgacgaggcgatcgtccggatgctgcaaaaatatcatgtttttgttttgctggaagtgttagagcatatagagaaagacaaagcgtttttatcgagtcttcctcaagggagcgacatggtgatttctgtgcctaactatgattcacgcgcccacgtccgccacttcaaacatattgacgaagtcatcgaaagatacgacggcattttggattttcagggcaccgaaaaagttgtcattaaaacatctgaacggctgaagaatgaaatttacgtgctgaattgtaaaaaaaggtaaacatcggcatagagcgagctaatgtggataacctgtgaagcgttagcttgtctttgcattaaaagagcatcccccaatcgcacatgcaagtctctgcagcttgcatgtgtcatttcaggagatgccatttgcaccggcgcaattatgattggttcagcagcttctcgaccctttcacggacttgcggaaccgaaagaccgataataatttgcaaggcttttccgtttctgacgacaccgtgaacgccaaaggacttaaacgtactgtccggctccacttttgactcgtcatacacgctgactctcagtcttgtcgcgcagtttgtcacctccgcaatgttttcttttccgccgagcgctttgatgcaaagaaccgcctgatcggtctcagcaatttcctgcgccgcagaaacctctttttcggattcttttttcgccttgtaatcttttttcgaataaaattttgtctcctgctgctggtctttttcacgccccggcgtggcaatatccaattttaaaatcaagaacctgaatacgaagaagtaaatggcggtgaaagacaagccgatcaaaatttgaaaaacataagtgctgccgtgctgatgaaacagagggatccagttgagcgttaaaatctcgattaaaccgccgcccatatttccgaccacccctgcagcatacatcaaggttgccatcgtcgtggccaagaggctgtgtacgaaaaacagcagcggcgaaatgaacaaaaacgtaaattcaatcggctccgtgatccccgcaattaccgctgtcagcgtgatcggaatcagcagaccggcaacgatttttttcttttcttttttggctgttacatagatggctagtgcgatccccagaattccgaagattttggagtttccgtggagcgcgaatccgccttgaggaaagagctctttcaacggttcagagcttgctgaaaactcgctgagatgctgcgcccaataggtgacaatcccgccttcaactacggccgggccgaaaacaaatggcgtgtatatgaagtgatgcaggcccgtagggatcaaaattctttctaaaaatgtgtaaacccatacaccgaaagcacctgaggcgacaaggaagctttgcagcgacgcaatgccgtcctgcaccatcggccaaatccacgcggttgccagtgctaccggaagcataatcgcaaatgaaataatgacgacgaatgaagagccttgaaaaatccctaaaaaatcgggcagcttcttatcaaaatagcggttgtggatataaacgacaatcgatgaaatcagaatcgccccgataatgttcgtatcaagggttttgatgccggcaatttctgcaagcccgcttgttcctcctgcttcctgagtcatatcaactccgaaaaagtcgccccatacagtcaaaatagcgctgacaaaataattgaaggtcaaataagtagtaagcgcttccaaacatgcccgcgcttgcgctttttttgccagtgcgatcggaattccgaccgcaaacaacagcggcatttgcctgaaaacggtccagccgccttcctcaaggatataccagaattgataccaaaaggtatcctgactggcaagcgatcccatcagctgctcattcttaaataatgtgctgaggcccacgacgatcccggcaaaagcaaatagcaaaaccggcacaaacatggcgcttccgaaccgctgtactttttgcatcaatgcgaatcccccctgttactcctgatttttcttttcttcagcatagtcgacatagctgcgaaacagcgcttccccaacgagaaaaaagggtgcaaaagcggtcagctctgtttttggataaaccgtcaccgtctggctcggcgcatagagattgtaaggagtgagctgggcgagcagattatttttcaaattcgtcaaagagataaaaggaatgcctttagccgacaaagactgtgcctgcggaatcagcgacggggtttctcctgacagcgaaatgatgatgatcagatcggccgtgctaaaatcaggaaacatgaggtcgaaatcgatttgatctttgatcaccgtcaaataacggtgctgagaaacaaacattcgctgcagctcataagcgcacgtcgtctgagccgtgcctgaaccatagacaaaaatccggtccgcttcgtcaatgagctggcacatctttcgcaaatccgtatttttcaaatatttcatgctcgcttccatatccctcatgaggctttcaaaggaacggcaatcttcccgctcttcttcccgcttctcggcctcccacttcagaaacaccctgaactcgctgtacccgctgaaatccagtttttgagaaagtcttaaaatcgatgtgcgggatacattgcacttctttgctaattcgttgatgcccagcttgtagcaagtgtcttgatggttcaaaatatatttcaaaacatgaaaatcgttttcgttcaattttttataatgcttgttcattaattcttccaactgcatcattttccccccatttattctctgtctctattatataaaatacgagaataaatggggggatatgcctgggctggcggtctggctcaggagccccaggcgctttcatccttaaagcgacggctgaagattttccgcggagagctccggccaatagcctttgttcgcttcaatcagatcatcgagaatcagtttggctgttcgtgcattcggcacagtccgcgacaaaatcagagcctgccaaagcttttgatacgatttttcaatccaggcttcaacgacaagcttttcaaccgacacctgctgttccatcagccctttttggaactgcggtattttgccgattgtgatcggctccggaccgttcttgccgacaatgcaaggcacctctaccatcgccgatgaatcgaagttttggatcgctccgttattttcaacgattaaaagcatccgttcaccggtattgaatgcaagggcgcgcgcaaggtcgacaatatatgaagcatgatcatcaatttcgattttgctgccggcgctcgattgggcttttgcgattttttcacactcgccgaaaatgaatttctcccgcccttccattacttcgttcgcccgggtaaattcagggtttgattttttcaccatatcatcaggataaaaataatattgcaaatacgtatttggaagcgtctcaggatcgagttcaaatacttcccgcgcttttttgaacgtgtcattccagctcgcctcagccttttcatgctcctgttccggaatatagccgaacctcctgacatgctctttgatcgccggcatcagatcgttgccgtctttatcacaaattgacgtccaccagccaaaatgattaaggccgtaatagcggacaaccatctccttccgcgaagacagtccgagaatctgagccatcctgtcttcgataccgatcggcatatcgcaaatgttcagcacttttgatgtcggccgcagccttcttgtcgcttcggcgacgattgcagccgggtttgaatagttcagcatccacgcgtcaggcgaataggtttccatataatcaatgagctcaagcacgccgccaatcgacctcattccgtacgcaatccctccgggtccgcacgtctcctggccgacgactccgtatttcagagggatcttttcatcgagctcacgcattgcatatttaccgactctgatatgagccatgacgaaatcaacatcggaaaacgcctcttccggatcggtcgtcgctaaaaattgaatatgcggagctctttctttaaccaacacttcacaagcgccggctattttgtcttgccgctctccatcattgtcatacaatttcagctgtcggatcgggaaatcatccagattgtccaagagcatcaatacaatccccggggtaaatgtgcttcctccgcctgcaatgacaatcgaatacgttttatccatttttaaagcccccttataagcgtttacaatttacttatatcatgctgaaggagccgttccaacaggttcgggggagacagttcctatactcgcgttctgtttattttcccgaaaaacgggaactttcccggccgttttatgtcgtgtagaatagagacaattcacgtgaattggagtgtgttgttgatgatgatcgcaatcggtttatttttactggcgggtttggctgaaatcgcgggcggctatctcgtatggctgtggctgagggaatccaaaccattgtggtacgggttggccggagggctgactttaatcatttacggcgtcatcccggcttttcaggcatttccatcgttcgggcgcgtctatgccgcgtacgggggcgtatttattattctggctgtgctttgggggtggctggtcgacaaaaaaacccccgacctctatgattgggccggggctgtgatctgtttagccggcgtcagcgtcatgctttgggcgccgagaggctaaaggttatattttcgaagccgcttgtaaaatgtgcttcttggaattccggccagcttggccgcttcggacacatttcctttcgttttttgcaaagcttccatcatcgtttgtttttgaacacgttctctgaatgtgagccggtcttcttcagaaggtgcgccgctgttccaatcgagtccgtccagcaccgcgctgtattgggacggatcgatcagtccgccttccggaaataaaaccctgagcctttcaaatgtattaaagagctcacggatgttaccaggccaatgatattcctgaagccgcttgaaaaaattcggcggaaactcggccttccactcgtgttgttgttgatagtggcggaacaaatcaggtatgtcctctttgcgctctctgagcggcggtatttttacggggtaaacatgaaggcggtaatacagatcttcacgtatctttcctttttggagaaggtctttcagatcacggtgtgttgctgtgatgattctgatgtcgaggggaacttcacgggttccgccgatcggagtgaccttccgctcttcgatgatccttaagagcgccacttgcatttgataagggatctcaccgatttcatcgagaaaaatcgtaccgcggtgagcctgttcaaacttcccttttgaaccgcggcgctttgctcctgtaaatgcgccttcggcatagccgaacaattcgctctccatcaagctttcaggaatggcgccgcagttgacggcgataaaagggccgtttctccgtgcgctcgcctgatgaatggccctcgcggcaagttcctttccggagcctgtttccccccatatgtatacattcgcatccgtcttagccgcaagcctcatgtggtgaagcgcctgctgaaacgcccggcttgttcctgtttcacccggatagatgaaacgggatacgagtgatggagctgttttattgcgggacacttcagccagtgcaatcgacttaccgaggggcctcccgtctttggcggagaaaattgtctgcttgtgccccccggcaaacccgcgctcatacagatcattgacatccattctcctccagtcggaaaaacgttcccgcaccggtctgctcgcggctacgattttgtctttttcattgcagacgataaacggctgatccgaatcgattttttcaagacaatggctgatgagctcggcttcgttttttttcgtatgtgcgctgatctcgcgttcgatggcgtgtgcggcagtggcagccatcccaagcataaagggatgccttctatccgtgaggcaggaaatatcgattaaacccataacggtgccgtcttcatcgcgaatcggtgcagcagaacagctccaatggtgggaagcgaccgaaaaatgctcggtcccgtgaatggtgacagcttcgccgatttcaagtgcggttccgatggcgttcgtgccgacttctgtttccgtccagcgcacgccctcgacaaaattgatttttttcgcctcttcaagcgtcctccggcagccggccaagcttaatacgtacccgtcggcatcgatcaggagcgccatcatttccgactcttttaattcacggctgatattgtgtagataaggcagggcgatatcgaggaataacgagtgtttctttttttgagcgtcgaataaatccttttttaaaattgactgtcctttatctaaatacggattgacatttcgatttttgcagcggtaccatgattccatgactcttttgttcaagcgggcctgatcaagaagcccttcctgaacaaagcgtttccacgtatttaaatagcagggcgtcggattcattccatcctctcctcatgctttttcctcattatattataaaagcgctttcaatatcgataaaaaaaactccgcactctcacgctgtgcgaagttctcccttattcagcagtgaatggcccgacctgcggcttgcagcaaagcttcgtgaatcgtttccgaaagagtcggatgggccgcgatgaagtgctccattgcgtctgccgtcagctctgcatgcaacattacggctgcctggccgatcagttcggttgctcccggacccacgatcgaaaccccgacaatttcctgatactccggctctatgatgattttgaccttgccggcagtttcattcaaaataagcgcttttccgtttgaagaaaacggaaactctccgatacgaacatccctgtagcgctccctcgcctttttttcatttaagccgacgcttgcgatttcaggcgaagtatagatgcagcgcggaataatgtcactgttgaccttcatgtctctgcctgaggcatgggatgcggcgacggttccttcgtgaaaagcggcatgcgccagctgaaccccgcctgtgatatccccgcacgcataaatatgcgggatgtttgtctgcatatgctggttgacatgaatccctttcctgtcatattggactccgatatggtcaagcttcagatcatcagtcctcggctttcggccgacggcgacgagacatcgatcagcttgaatattaaagctgtcatcgccatttttcagaaagacgcgctgcctggcaggatcaagacgctccacttgtacagatgtgaaaacacggacgccggactcctcgagacttgtgcgaagaaaggcggcaatatccggatcttcctcaggcagaatctgttccgcctgctcggctatgatcacattcgctcccagcctgctgtatatactggcaaattcacagccgatgattcctccgccgataataaaaatcgtttcagggatggacggcaatgacatggcatctccgctgtggatgatccagctcccgtcaaaagacgcaaaaggcagtgcggcaggtgctgcccctgccgctataatcacatgcccggcattgatgacctcctgttttccgtccttttcaacaagtatgtcgtgttcggacaaaaacgatgcttttccttgcagaaccttgattttatttttattcatcaaatattcaatacccccggcgagccgctgaatgatctctctcttacggctttggacggcctcccactgaaccgtcgggctttcgcctgacagcccgattccgaatgcgccggcggattttattttctcgaacatatctgcgctttcaagaagcgctttggtcggtatgcatccttcatttaaacacgttcctccgagggaaccatcttcaatcaggatgacttctctgctatttttggccgctgtaatcgccgccacgtaacccgcaggtccccctcctataattgcaagtgtcacagtctatccaccttctctctataaaagaattgatgccggatcttccaaatagtttttcacatctgaaaggaatgctgcagcaggcgcaccatcaagcgcgcggtgatcaaaagtcagactgagcggcagaatggcgccctttgtcagttctccgtcttgataaacgggtgccgaatacatttggccgactccgagtatcccggtttccggcggattcaagatcggggtaaagtgctcgacaccatatgcgccgaggtttgtaatcgtaaatgtcgatccttctatttcatcgtgtagaagccggccttcccgcgcttttttggcgtaccatttgattttcttggccaattcgatcagcgggagccgctcggcatggcggatgacgggaacggccaggccttcgtccaaagcggccgccactcctaaatgaacatgctcaaaggtcgcaagccttccgtcttgataaacactgttcatggccggatgatccaaaagcgaaaaaacagctgccctggcggcaaaatcagtgatcgtcagcttcgtatcgtatcttgattgagcggtttcattaagctgtttttgcaggactgttaatttcgtgatgtccgccttcatcgtaatcgtcagctgggcgctgttttgcaggctttccgtcattcttgcggctatcgttttcctcatcgggcttgccggcggccgctcttcagcttcagccttagccgcctgcttgttcggccggccgggaagcgcctgcaacacatccgctttcgtaattctccccccggggcctgtgcccttcagcgttttaatgtctatatttgcgctttgcgcaattttgcgcgcagccggagaaattttaatccgttctttcgtgggatccggctgttttgtttggctctcctgcgtttgttcgttttcatttccgatgcggcagatgacggttcccggcggcactccctctccttcggatacttggatgtccaacacggttccgtttgccggagattcgatttccatttcgattttttcggaatttatgctggcaatgctttctcctttttcaacggcttccccgacttttttattccagacggaaaccgtaccttctttcatcgacatccccaatttcggcatgaccacttcgacagccatgttctcctctcctttccaatctttacaccgtatgtgttgatgtttctccgagcatctcaagcacggtgttcacgactttttccggcgtcggcaaatacaggtcttcaagaggcggtgaaaatggcaccggcgtatgcggagccgtcacctttttaaccggtgcgtcaagcgaatcaaatcctttatctgccgccaatgatgcgatatccgcggcgatgctgcatctcggattggcctcatcgacgatcacaagcctgtttgttttttctacggatgcaaggacggcctcttcatcaagcggcgaaaggcttcgcggatcaaggatttcggcttcgattccccgcgctgagagctgttccgccgcttgaagcgccgtatgaacctgtttgccgattgcaacaatcgttacatcggcgcctttccgcttgatatctgcttttccgattggaagcgtgtaatattcttccggcacatcgcctgtcatgttgtacagcgttttgtcttcaaaaaagataaccgggtcctgatcttcaatcgcagcgagcaataatccttttgcgtcgtacggggtcgacggcacaatcactttcagtccgggaatgcttgtaaatagggcatacaagctttgcgaatgctgggcggccgccctaaagccggcgccgtgggtcgtccggatcgtaatcggaacttccgctttgccgccaaacatgtagcggaatttcgctccctggttcagcacctggtccaaacatgttccgataaaatcgttaaacatcaattccgcgatcggccttaaaccggttgaagcagcagccatggctgcgccgatgtaccccgcttcactgatcggcgtatcaaggacgcgctcccgtccaaattcctgaacaatccctttcgtgacgccgagcacaccgccccatgcttcatcatcctgcagatgatcgacattcgctcctcctgcgacatcttcccccattaaaatgacgtgatcgtcccttctcatcgcaagtttgatcgcttcattcaatgcggctgacatgctgatttccctcgtcatgtttccttcccccttcatgaattaataggatacatatacatccgtcagcagttcggtttcttccggataagcgcttttttcgctgaatgcgaccgcttcctcgaccgcttcttcaacttctttttcaatccgcgactgctcttcttcactcatcagcccttttgccagcagttcgcttttgaacacggcaatggcatctttttcttcctgatgcaccgctttttcttcatttgttttgtagcgctgggcatctccttcaaaatggccgtagttccggtatgtcatacactcaatgagcgtcggtccttctccgtttttggcacgctctatcgcccggcccgcagcctggaagaccgcggccgcatcttttccatcaacgcgaacgcccggaatcccataagcggccgcacgatctgcgatcgactcgcagcttgacgcataggaaaacggagtcgcttcgccatacccgttgttttcggcgacaaatatgacagggagcttccagatggcggcaaggttgatcccttcgtgaaatgtcccctggttgttggcgccgtcgccaaaaaagcaaacgcttacatttttagtctttttatactttgcagtgagagctgctccgcaggccaaaggaaatcccccgccgacgattccgtttgcgcctagcatccctttgtcaaagtctgcaatatgcatcgatccgccttttcctttacaaagtcctgcagattttccgtatatctcggccatcatgcctttcaagtcgcacccttttgcaatgcagtgcccatggccgcgatgtgtgctcgtgatggtgtcttcatcattcagatgagcgcagacgcccgcagcgaccgcttcttctccggcgtaaagatggacaaaacccggcagtattcctttagcaaacagctgatgaacctgatcttcgaaatagcggatttccagcattttttgatacatccacactgctttttcctttgtcagtgcctcttccatatgaaaaaacctcctgtcttttttactcacacgttatgatgcaaaaatcgtgccagctctccgaagcgaacataagccgcttttcaggcggacatcctttcagaacaagagacaaaacgagacaggtgtctcaatttgtctacttcgtcagttgcggaaatgtcgttgccgcggttagaatgaacggtagagacgaaggaggttttttcatgaagaaagcgtatgtttttttaatcgacggattcgaagaaattgaagcgatagcaacaattgatgttttacgaagggcagaagttgagaccgtcaccgtctcgcttgatccatcgcgcagcgtgaaaggcggacatgacattgtcgtcgaggcagacgtcatgtttgacgatgctgattggcaagaagcggatatgctgattcttccgggcggaaatgtaggcagcaaaaaaatgctggagcatcaagctctgcataagacgctgacagaagcggcaaatgcaggaaaatatgttgccgccatttgtgcggcaacgatgacgctcggaaaaacggggcttgtcagcggaaaaaaagcgacctgctatccgggagttgaagaacatttaacaggggcggatgtcaccgcacatgaaaacgtcgtcgttgatggaaatatcattacttccagagggccggcgaccacgatcccgtttgccctcaagcttgccgaactgctgaacggcaaggaaaaagccggtgcagtcgccaagggaatgctcgtctgctaagacggcattcctcttttttatccaataaaagaacggtattgacatcataaatcttaaaagatatgatatttaaaaagtaattccgtaaaatcaataatcgtaatctcatgcaaaagagctttagcattcggctataatcccattatggtcgcatgaaaaagcaacctttaccatgcatgacattaacattttgataggacggtatatttcattttccctattctcttgtataaggaaaagaaatataccgtttttcaggaggatatagcattggaaaaacagaaagtgacgaaggggtctttggaggcggagataagcaaagccttaacccaatgggaaaaagactatttgggacgcggatccgtatctgttaaaacagatattataagaaatatggtcatcgtttccctgaacggtattttgacgcccgccgaatacgaactttgcagtacaaaagaaggcctgctgtcaattaaaagaacccgctccggtttggtggaatcgggtatagagcagctgagccgcatgatgaagaagctgaccggtgaagagacgatcagctttcatacggatatcagcacgcgcacaggcgaacggattatggtgtttaaattggcaaacgacctgcaaaaaaaattgtcatagaaaaacggaagatctttaaagcatgaacatgagttaaagataagccggtatcattcagaaagattggctgaaataggccagtcctgaatataccggctttttttacgttttcagaaaggaaggcaagatatgaaacagtatgttctattccatcatcccgacggagggatgccggatgtttgatatgctagattctttattttggctgaaaatatttttcgcgtcgcttgcgctttgtatgttcagcgcactgctcgtcctgaatcgaaaggttccattggcatatgtacggattcatgccaaaatcatcgccctgcctccgcttgccgcgctggcagcattgataacggcaaatcccgggcaggctgaagcttcttggcgcttggattcgcttgcttggctgatcgccttgtttgtcttgactatcggcttcatcgtccagcgctactctgtccggtatttattcggcgaccgctcctaccgtaaattttttgtgctgctgacgcttacgacaggaggagcttcatgcgcctggctgaacgatgatcttcgctggctccttttatgctgggggatcacgctgctcggcttgactgcgctaatcggcttaaacagcgcgtggcaggcggcgaaaaatgccgctttgtatgcgggccggatctttgcgctcagctggctggcgatagcagctgccgctctttggctgtctctttcgacgggacactggcgattatcatccgccatagcggaagaaagccttgtacagctcagctcatgggagaaaaccgggatcggcctcctcgtcattttaacggtgatgattcctgcggcacagtggccgtttcatcgttggctgctcgattcagcaatcgctccgactcccgtttccgcagtcatgcacgccggacttgtaaatgtaggcggcgtcatgctgtctcgttttgcaccgatgttcagcggtgatgtactgcagcttattctgcttgtacccgccgtcctttccgtcttgctcggaacgggcatgatgatcgtccaaacggactacaagcggcagctcgcagcttcaacggtcgcgcagatgggttttatgctcgtccaatgcgcattaggggcctatattgcggctgttattcacctcattttgcacggcctgttcaaagccgcccttttcctgcaagccggatcagcggtgcgccgttatgaatcgttcgcatctaaaccgggcagaccggctcttttttggaacatgataggcggcgtctttgctcttgctctcgtcatcggaatctgggcctcagctgcggacgatggctatcaattgatcagcgcccttgttttaggctgggcactgttcattgcttggaggcagcttgtcacagccaattacggacgcgtcacacgaattgccggacttttcattttaacaggggcttcactcgcgtttgccatcattcattccgttttacacgggctcctgaaggatgctgttgtacagggggctgagccgcctgcaatggcggccgttttgacggcagtcgttttgttagccggcagtgcggccggcgcgttgatcgttcggcagcgctttgcatggtccggcgcactttatttacgtcttgtgaaaacgggtgaaccccatttcgaatcggtcgaagaacggccgaattatcttgaccaatatcttactcagggaggtcgccaatcatgaaagcagcacccacattgtctaaacaattgatattccaatatgaacatcagactgcggactttaatatggatgagttggttcaatcagcagcacgggtcatcgcgccgctttggccgattgaaacctttgccgctcgtcatccgtggatgggccttgaagaacaaacatttgaacagacggcccggcagcttaaacagcagcttcatgttgatatctacccaaagtcctccattttccgttccgcaaaacaacggggagaaatcgttgagacgattcttgaaaaaaagctgatcaattggctcgattcacatcagcccggcatgcagagggaaacagcggaggcattttgcaaagccgccctcaagctggacgaaatacctggacagctcttgagatcccggcaagtgaaaaagcttgccaaacaagcggcccgcgggacaatcgatggccgaaaaacaagctttatcaaaccgctcagcgtttttgccggacagaaaagtgctcacctccttgaccatcatgtgattaaatggtgcaagctgttccttgatgaatcacaatcggcatggcggcttccgcatcgtgagaaagggttttacagcgcatggcggcagcttgttgaacatgatcccgctctgtcgcgcgcagaacgccaacgcctgaatggatggccggaagagccgcgggacgctatgaaaaaagcgctccgagcgtttgatatttccaatgtagacgttcaggcataccttgaagctcatctgctttctctgccgggatgggccgggatgatgctttggcgttctcagcaatcgcaggacgaagaagaactgctgctcgagtatttggctgtccggctttcaatggaatggatgcttgttgagccttatttaccgatgcctaagccgaatcctgaaaaagagatgcagctcgttcctttgattgcgtcctggctgcattggggcggccttacgcctgaagaatggctcgaactttccgcagcagagcaaaaagcgagattaacactcgcccgccgctttgatgatataacgcgcaggcgtctctggctggaagcttgggaacaaacatacgccgctgaggtaaggaagctcatcacggcaaacaaacctgccgctgctgacaaaagcgaaacggtgctggcccaattcgcattttgtattgacgtccgttcagagccgttccgcagggcattggaaaagtcaggcccttttgaaacatatggaacagcgggctttttcaatatggcaatcgaaacgtgcgaactaggcactaaacacagccacagctctctgccggtcatcctaaaaccgcagcatcgagtagaagaaacggccgaagaattaccctttaagtcgtatcaagaacataaaaaagcggcagcctcactgagctccgcctttaaaacgatgaaacagaatctattggcgggcatgctgcttcccgaagtgagcgggccttggctgagcctgcaaatggccgcgcgcagccttgtcccccgcgcagccgggcaagcattcagaaatgcgcggaaaacatggctgaagaagcctcagacaaagctctcgcttgatcgcatggaaacatctgaagccggcattccagtcggatttacggaagaagaaaaagccgcttatgccagacaggcattgaagatgatgggcatcacagaccggttcgctccgctggttgtcatttgcgggcacggcagcagaagcacgaataacccttatgcctctgcactggactgcggcgcctgcgggggcgcctcaggcgctttcaacgcacgcgtcctagccgctttatgcaatcttccaagcgtcagacagaggcttcgctccgacggcatttttattccggatgatacggtattcgctgccgcagagcacattacaactttggatgaactgcactggctctatgtacctgagctgccggctaaagctcaacaagcgtttgaccgcatcaactctgtgcttcccgatgtgagccgtactgtcggagccgaacgcttagaagagctgccgcagctcggctatcaaaatccgcggaatgaagttgagcgcttcgccgaagattggagcgaaatccgtcccgaatgggggctggcccgaaatgcctcattcatcatcggcacacgccggcttacacggggggccgaccttgagggaagggcttttctgcacagctatgactggcggaatgacgaggacggctccatccttagcggcatcatttcagggcctggaacagtggcccaatggatcaatctgcagtattacgcgtcaaccgttgcaccgcattattatggaagcggaaataaagcaactcaaaccgtcactgccggtctcggcgttatgcaaggaaatgcaagcgatcttttggccggtctcccatggcagtccgtcatgcggtcagatgacgaaatctatcatgcgcctctcaggctgctgatcgtgattgaagcgccggatgatgatatcgaacggctccttgaccgcgatcacagcttccggcaaaaggcggagaacggatggattcatctggcatctattaatccggagggaaaatggaagaactggacaaacacgataaatgaatgaggtgaaatgtcatggaagaaaacaaaaaaatactcatgattatcggaatggagaaacagcttgaacagaccatctgccgggcagcaaatattcagccggaggacgccctcgttttaaaaagcgtcttccctgatatttcacagccctacggtgatttcatgagggatatcatcacccttgtccaccggaacaaagcggaagaaatctggattgtccgcgacaaatacgaaccatcggcagatgaagatatttctgaccttttaaatagagacaaagatttaaaagatagaatgcaaactttagagtaccttttccaaaactgcagtccggaatttacgcaaggcagcattgatgaatggctgtcaccgagcgaaaacgtggccgaaggtgtacaaaaaagcgtcgccgccatccgcaggcacccgttaatccctttgcacgtcaaagtgaaaggatttctaatcgataaatcggttttaacggaagttgaagctttaaacaaaaacggagcccgttaacagggctccgttttgtcttaaacgcaggcatctttacacgacagcagaccgctgataaaatctctgaatatgcatggtaatgtagcacagctctttttccggaaattcaaagccatactcccgcttcacaaatgccccgatttcttctgcgcacataaacgcttgtccaaacttctttttaatgaggctgatcatctcaccatccatttcgtaaaatgtctctcccgactcgatatgctgaatggcgaaacggagatggttgacaagccgctcatacgaaatcgtctcatcctttattttaatgttgagtttgttttcgatgatctcgataatatccttgatcatcgttgtgagatcgagcgtttttgtcatatctcccgcgtttgttttggctgtgtggatatgcagcgcaatattggcgacttcatcctcggggatatcgatcttcagcttttctttaatgagagcctttgcccagcggccgatttgaaattctttcgtgtagaggactttgacttcttgaagcagcggatttttaatgaccattcccttgcttaaccgttctatcgcgaaggataaatgatctgaaaaggcgacatggattcgctcattgattttgatcccgagctctttttccgcataagaaataatatcctccgccacctgaatatgatcttccggcaatgtttttaagatctcctcgaattggcggtattctgatgaatctttcatcacgaatattttttcaattttagatctgtcgacaatatcattcttctttttttgaaatgcgattccggaccctaatacgatcttttcctcgccgcgatcctttacgacgagcgcattgttgtttaagattttttttactttcatagctgccttcctttcatcctgttttaatgaatgaaaacggaattattctttttcatctttaaagccaagacacaaagtcgcaatgaatgctgaaatcaccgcaatcgcaaaagcgattaaataatgaatgagattggcggtgccaagagggagaataattgaaatcatcgggatgccggacaatccgtaagaatttgccgccacgtgtgtgaagacggcgtatgcacctccgagtgcgcctccgatcgatgcgccgataaacggcctgacgagtttcaggttgacgccaaacatgaccggttcgacgattcccaaaaaggccgtgagagaagccggaatcgcaatctttctgatgccggcattctttgttttcaaaaatacggcgagtcccgctcctccctgcgcgacattggccatcgaccatattggaagcagaaaattgaccccgtattcgggatctgcgagcagcgacgcttcaatcacataaaaactgtggtgaaggccgctcaaaacgagtaaggcgtaaagcccgccaaataaaaatccggcgcacgcccccgcaaaatgataaacaaacccgagacagtcgcttatgaaatgggcgatcatcagtgagagcgggcccatgataaacagcgcggcaaacccggaagccatgactgtaataaacggggcaacgatcaaatctaaagaactggggacgattcttttcaagaatttttcgattttgctcatcatgtagacggataagagaatcggaatgactgtcccctggtatccgatcaaagggacttcaaggccgaatacttcgatggattccggcttttggctgccgagcattgaaggatcgagcaaatcaggatgggtcaaaataccgccgatgacggcgcctaaaaatggattggctccaaactgtttagccgcactgaacccgatcagcacaggcaaaatgacaaacgctgagcttgaaaaaatgtcgagcattttcatcagcgggccgccataagcgccgaggctgaattctttaagcacactaatgagacccatgagcaatccgctcgcaacgattgcaggaatgatcggcacaaagatgtctgacagccttttggcaaatcgcgtcaatacgttcatgttcggccgcgcctcccgacgggcttcttcaaaaggagccggatcgctgtattggatcatttccttataaattttattgaccacacctgtaccgaaaatgatctggaacaaaccgtatctgaaaaaagtcccctgcacagactccatcttttcaatagcagctatatcgattttttcttcatccctgacattgaagcgcagccttgtcgtacaatggctgatgctgatgatattctccgcgcctccaatgaggggcaagagttctcttgcaatctctttatgctgcacccgcacctacctcctccaatttttctatcctatcaaatcaacagaagacgatcaaaatgaaaaatgtgtcattacgtctaaagccccctggcgaaagaaacaaaaaaagacctaaaacatgcgaaagcatcagccgataggcgcaaaaaagcacactaagggctgcggttcctttagcacattttaggtcttgcctgccttaccagtaacaatcccggcgatattggttcttaatatgattctattctcttcggccatggacatcaatagtgcaaaccacctatatatcctgcatatataaaaaagagaaggcgctacaagcgccttctctacgtattcaggtggcaattgcgcgttccttgcagccgggccgttcttcccccttctaaacccatactgtcaatctcaatgttttcataatggctttctttttcaattcaatcaactctttccaaattttcgcgtccgtctattatgacgcagaattcagacattaggcaagctctttctgcttcgtctcggtccccaaaaagatgatggctgcgacggccgcaacaacggcgatgcagaagatgaaaaagatcattgaaatctctgttccccgggcgacgagatagccgacaagaagcgggcccaggatgccgccgattcggccaaagccggctgccattcctgcgccggtccccctgattgacgtcgggtattgttccggggtataagcgtaaagcgcaccccacgcaccaaggttgaaaaatgataaaaacatgcctgacacaagcaaaagcgccagcgattcagccgatccgaagaagtaggcgctgacagccgtccccagcaagtagacggtaagcaccattttccgaccggctttttcaatcagccatgccgcggagaaatagccgggcagctgagccagcgtcataatcaggacgtactcaaagctcttgatcatgctgaatcctttcatcaccatgacgctcggcagccaaagaaacatgccatagtaggaaaagacgacgcaaaaccagacgatccacagcatggccgtaggccgggcatatttgcgggaccagacgcttttcacattttccatgatggtcggcttcctttcctgcgcaagcttctcatatttcggagaatccggcagggcaatccgcaaatataaggcgtaaaaagccggtatcgcagttatcaataaagcaatctgccagccgtaggccggaataataaaatacgaaatgagcgctgcagccagccagccgaatgcccagaaactttcgagcaggacgacgactcttcccctccgatcaggcgcaacggtttcagatacgagcgtagatgcgactggaagctctcccccgagccccattccgacgaaaaagcgcagcactaaaaatgcccacaatgtcgtcgttaaagcggacaacccgctgccgatcgagaaaaacagcagcgtaataataaaaacatattttcttccgacgcggtcagccaaaaggccaaagacaaatgccccgacagccatgccgattgagttgacgctgccgatccagctcatttcctgcggcgtcaacttccattccgcgtgcaaagcggcgataataaacgataatataccaacgtccatggcatcaaaaagccagccgaggcctgcgatgccaagcagtctgcgctctgaaacaggacggttcttcatactcacaacacctcttttactctcttagcagtttacatgagtattagtttacacctgtctttacacttttgtcacgaagaaaatgaggcgccgtctttttcagtttaatgaatgtgatgcgggcgaaacttttctttatggtgcttccactttggcaaaaatccgtcttcccgctctttttcatagcgcttttcaatatgagacttgatttcctttcccctttcctgatcaagtattccgtactccacatacttattgatcagctgttttttcttttccataatgtccttttgcaaagaagccagttcatttttctgcttgtccgtcaactcttgataaacgcgtgtttccccgtaggcagagggcatgacagccgtacatgacagcggaatgacgagaagcaggcaaacgcacagtttgcgcatcatgcaacatcctttctgatctatgattcattctatttttttcttttttgcggtgtttatgcataaaaaaagccgcttagtagcggctttctgttatggctgcagcgactttttccgcgccgtatattcatcaatacgcgccaatgcatctttaatgtccatgcagttgctgaagctttcatcaattttttgaataccttcctgatattttccgtcagtgagcacttgttctgctgcatctctcaatctttcagcattcacttcttctgcaaacagaggatatcccgcattcagctctttcaagcgctgggcgatcatcggctgatctttatcatgcggaagcacgaccatcgggacacggtaatggatgccttcattgacgctgttcatgccgccgtgcgtgatgaacacatcggcctctttaagcacctctaattgcggcacatacggggcgatgataaaatgctccggcacttctttaatttccgcgtagtccgatttttcgccagcggcgatgacaaccttgccgtcgaaatcacggaaagcatcaatgcacatattgaaaaaatccgcagttttgccaagtacggttcccattgaaatataaatgactttctcattcttcaacgattctaccggaaaatcggtcttgtccaggcgctttggaaaacgcgggccgataaacagcacatcatccccaaaacggccgctgtcaggctgaaaataccggcttgtatacacaacggtcagctccgcctgattgctcataaactgtcctgtatgcctaggcgagacgccgtacttttctttcagttccgtaagcaggtcctcacattctttgtccaagtgcagctccgcgcctgaatccggatgcaacggcagaatcttcatatgttcttgtccgaagagaaatgaagccgacgaagcgattcccggaatgttcaaataatccctgaccaattcacccgcaccgaatgtgtcataatacacgacatcgaacgaaatgcttttggacagctcttttacaatgtctagaatatacagcgaggttttgagatgaatttttaaaaattcaagaaggccggacggtgaattcggatcaatatgcgcgtttctcaccagatctttgtataaatgaacggtagctccgacgccctccagcctgtctttatacttttctgttgaaagatagtgcacattgtcgcctctgtcagcaaatgctttggtgatccctaatgtaggattgacatgaccttccgccggaaaattgacgattaaaatatttttcatgatcataactcctttttatcctttttgaaacaggttgacatcaattgagcgcctgattagactgatgttagttactactaactatcataaaatgggggtaaacacctttgcaagagacgaacgaacggatcatatctgctgctttagacttaatgcaaaaatacggattcaagtcggtgacaataaaggatatcgcgcttcattcaggcgtcagcgagatgacggtctaccgccacttcaaaactaagcttggacttttggaagcggccgttcaacaattttcttatataccagcctttcagcgcgtatttgaaaacgatatcacttggaacctggagaaagacttaacattgattgcagaatcgtatttgcttcatatggaaaaaaacaagccgctctaccttatcgctgttcaagacggcggaaggatgactgatcttttcggttctctgttaaagcatatggaggagctcctttgttatttaacagactactttcggacgatgcaggacaaaaacctgatgaaaaagggagatgcagattcacaggccttcgcttttctgtcatctttatacggatacttctcgtctggcgcattggctggcggccgttttcaaaaagtcgctaaagacacttatattaaacagataaccgccgccttctgcggcggcttgcatgtatgatatcatccttcaaactgaaggatggatcgttaatcatttagctcttcaacatccttcagcttgatttccgtatttttttcaaaggaggtgctgtatttaagacagccgatctcctcgtctttaatatcttccccatcaaaaatgttggcattaatcgtcacgctttcgtagtcgtacccttcttcattcaacaggcgctgaatcttttgcgccgtattgtatacttcttttcggccggcattttcggcatcaagtaaaatatgaatctgcatcggcttgtctaagcggatgcttttctcccattttgcgtcatttttcagctttccttttaatacttccacatgcacgtcaacgtctttcagttggtctatgctttttgataaaagcgctttgatttcttttcctgcttcttctccaagccgctccatcagcggttcattgaggttctcttcatagattccgtccgtgtatacttcaggttgaacaaaccctctcaaagtaagcagatagggatctttgcgctttggatcaccggtgtcagtgacttcaaatacatattccgtgaacttgaaattatagatgccgctgtcgatccgcaagtctttttcaggatagcggtcagtcaaataatgctcaagcgccgtttgagacagcttcttgcttacgggatttccgttgaaggcgttgtaagcggcaagcacaaaggaaacgagcagcacaatcaacacgctatacaagactttctttttcatcatatcaacttctttccttcagctttaagaacagccagccgatcatcatcccaaccgcggcgaaaaaacagtgaataacagcgagcacgaaagcgccaaggacggcatacagcaggtgctccacaacccctgtaccgccggctgcgtcccatccggccaaaatatcccccatcccccaaacgaaaatcggcgcaaaggagaggagcatcacgagtttcatatcccagaaaaacagataccccgcaaacccaagcacggcgtaccacaaaataaagccgaagctttcatttaacagggatgtgcgaatcgcgagaaaaaatgaaatcgccataaacatcagctggtacaaggagagctttcgattgattcttttaaacatttgcccttcatgaacagacgactcgatatgttccttcggaagctcgtcttccgacatcttcaaaagcttttgaagctcctcatcgttttcggccgcttcctcaatccattcagccgtctctttgcttaacagcccctcatggtataaaggaagcaaatcttcgaatatactgcgttccttatccttcatcatacccctccatttcttgctgaagcttgaccttcgccctgtgaacccccaccctggcatagttttcggttttgcctgtgagcatgccgattttcgtagatgcggaggctgacaatctcctgtaaattctcatcaagccggttgatttcctcgagaagccgccgctctttcacggttttcaggaagtgttcttccggagataagcaagctgccttaacttggtgaatcattgtgtttgccccggctttcgacgctcctgaacgaaagtgtttttttagcaatcgcaaacacccgtgttttgattgtcggctttcccaaaaatgtgtgggagccagcctttcacagcctgataaaatgcttcctgtgttaaatcttccgctgtttctttaatttttccattcacttattagtaccgctgaccttcttttcgttacaaaaatcacataaaaaaaagagacaaaaatgaatatttcattttgcctcccgatatcccaatcgccaaacaaacatcttccggtctctcggatgatgccctgtcctttattttgagggccctgccagcgattttaaaaaaactcatttttttcatgttcaccaagttcccggccttcatcgacagcccgcttcagcgcctgcagcatatagccgattccccgatatcccgccagcgggtatatgatctgctgtccgctgccaaacacgttcctcagtacaggcctgtatttttttccgccgagcatgacgatttcatcgcaatccatcaggtttttccgttcaccttgagccttcagcccgccatccggcataatctctgggtggcgcatcccaaatgtgacgtcatagttttcaggaacgatatcttcaggttttaaaaaaccgtgttttgctgaaagaatcacccaatccgtaaaaaatgtctgcgcatatgcgcggcacgcccggtgaaatgggcttagatagacatcctttgcggcggacgggccgatgtccggatcaacatcccagatttttttcgccccgcacgggatgatgcaaagtcttttcatcatgtatcccccttttgtttccgctaaaaaacgcctttaaaaaggcgttttatttcagcttcagcgatacgaccgattcgacgtgcgccgtctgcggaaacatatcgacaggctgaatgtattctacatggtaatccttcgccaagtactgcaaatctttcgcaagtgttgacggattgcatgagacataaacgaaccgcttcggcttaacctgcctgatcgtatcaaggaacgtgcggtcacagcctgttcttggcggatcgacgatgacgacgtcgggcctgaagccttcttttgtccatttcggcagccagtgctcggccgttcctgttacatagcgcgcattttcgattccgtgctttttggcgttttggttggcgtcatcaatcgattctttgatgacgtccatgccgcggatttcttttgccccgtcggcgatccacattccgatcgtgccgacgccgcaatatgcgtcgacgactttttcgcgcccggtcagttttgccgcttttttcacttcgtcatacagcttgactgtctggatcggattgagctgaaaaaaagcgcgggcgctcagctcaaatgaaacctctccgagaaattcctgaatgaccatattgccggctaagagccttgtatcatcgccgaagacaaccgatgttttggctttgttgacgttttgaatcacagatgtcacttcaggcagacgcttcttgatttcttctgcaatgagctccttgcgtggcaggtcttcttttgacgtgacaaggacaacctgcacttcccccgtctcgaagccgaccctcgtcacgatcgtgcggacatcgcccgtgcgcttccgttcgttgtagacggaaatgccgaagtcttcaagaacctgcttgacggtttgcgtcgttttgttcgtcgccggatgctgaacaatgcattccgtaatcgggacaagacggtgcgagtcaaggccgtacagcccggccaccatctttccgtttttcgaaagcccgagctgaaactggcttttattccgatagtgccacgggttttccatgccgatcgtcggcctgatgtccattttgccgatgtcaaaacgggtgtgccgttcgagcgattgaatgacgatgtcccgttttcctttcagctgctcttcataagccagatgctggagctggcagcccccgcattgctcatagatgatgcagggcggcttgacgcggtgctctgaacgtttgcgcacctttttgacccgcccttcggaaaatttcggatgaacctttgtcgcctcgacgacgacttcttctcccggcagcgcgccggggacgaagacgacttttttcttgaagtagccgacgccttcgccattgatgccgaggcgcttgatcgtcagcggaaattgctgtccgacttttaattctgctgatgatccttttttgtcacgtttcactgatgttctctccatttctactcgatgctcctccataaatacaaggaagcatagcttaaataagggtgccattctttgctcatttcaagcatttgttcttttgtcggtttatcgtttaagccaaaatggcgtttgatggcattttggatgccgatatcggctgccggaaacagattgggacggccgagtccgaacagcagaacgttttggacggtccacgggccgattcctctgattttcaccagcttttccataatatcttcatctgataattgatcaagctcatcaagatctaaacggccgtctgcgatcatccttgatgtatcgatgacatattcagcctttcgcatgctgaattgaagttcgcgcagatcgttgtagtcaagctgtgcaatcgtttcgggaagcggataaaaccagaccccgtccttttgctctccaaaagtgtgaacgaaccgctccgtgagcgtataagcaaaagacaggttcagctgctggtggataatgcatttcatcaggcaatgatacaaatgaaaatcgagcaccagcggcgttccggcatgctcctcaaaaatcgatgataggcttgattgtgaaaagtgatccagtacaggctgaagactttcttcccatctgaagatccgtttcacttcttttatcatgtcatctcgatcgtctattccgctgacggcaaacgccggggcttcagcagttcccgtcgcctgcacagcgacaacccgaggctctttgttttgattgcggagcggcagcttgacctcccttttgtcgaggttgaccgcattgagcggatcaagcgaaagcctgtccaacacgcggtcaaaatgataaggcggtgttacgcttacagtttccttccacatcgcttcccatccctttttcttctttgtccacagtataccatgtttcaaattctcttaaaaaagaacaacattttatttttcatcgaatgaatcacagcacagcgcagcatcctatgtaagcggaggggtatcgatgattaaacattttgcgatgacaaaggacggacggcttttatccgacaacaaagcagaaaggctgacagatcaagatattgagtggttttggaccgatttcgatcagccttcggaagaagaagtctccttgctcaaaagccattttcactttcaccctttatcggtcgaagactgcgtacatcgcttgcagcgtcccaagctcgatcaatacgaagattatctttttttcgtcatacatgcgttgaatcaaaagactttggcgtctgaagaagttgatttattcgttggaaaggatttcatcgttacatttcattttcatcactcagacggcattgaaaaagtaagaagacagctttcggaaaacagcgagttgtggaaaaacggaccgggccacatcgcctatatggtcatggatacgcttgtggacgaatatttcccgattctttacaaaatagaagaccgcctcaatgaaattgccgaaagcgacagcaggaaaacgtatggaacgctgatgaacgaggtgtttgatatccgtggcgaccttttaaagctgaggaaaacaatcattccgatgcgggatttgctttaccggattttaaacattgaaatttcaaaagaaaaccgcgaacgaaaagcgtattacagcgacatttacgaccatctcttgaagctggccgaaatcgtcgaaaacaaccgtgacatgacagccgatttgagggacagctaccagacgctcaactccaaccggatgaacgccattatgatgacgctgacgatcgtctcaacgatttttattccgctcaccttcattgccggagtgtacggcatgaactttgacaacatgcctgaactgcattggcgctacggctattttttcatcctcggaataatggcagccgttgtcgccggcatgatcttctggttccggcataaaggatggtttgacattttcaagtaaaaccggaaacctttttcctctctgttcgactatttctacaactgaggagggaaagaaatgaaggtacatacagggcttgccggcatcatcatgatcgttatcgggctgttgatcagcgccgagaatcatcaaggcgcgtctgtagcagacgcgctttcgggctttttaaaactgcccatccggaatttagtggttctgatctgcatgtttatgatcatcgccggcttcattatggcgtggcgccattattatggagtaccgtggatccgctttaagctgtttttgtttatcatcggtaattcagtattttacccgctggtcacagaacagctgatgttctttcaaaaatggaatgcacaaggcgatagcgccgtggaatatatgaaaaggggaagcgcttgcagctatcagggcgatatggaagcaggaagcatggactgtgaggtgaaagtcaacaactacgggaaaaagaccgcacgcgtccagctcacccctgatataataaatgaatttgactttcagccggaagagctggaactgtcgccgcattcacaggaaacgtacagcgtcacctttacggctccgggaaatgaggatgcatttgcatccggaattgaagaagagccgaggttgaagattaaagtggtgaaatgaacggctgtcacacgagtcaaacagctcgtttttgggaaactgctataaaagaaattcataattttactctgggaaacgtaccacacaattcatattcaaaagcacggacagaccgccgattcacaaactaatatactaacccaaagcagaaagccgctccttcacggaaacggcttttcgtctattaatcgtgataagattctgcaatcgcgttggcggcgacgatcgcattgtagacgtcgtcaggggtgactgggaacggcatgttgcccattgtgtcgccttccgcgcaagcgctttgagcgacttggcgccattcttcttcgacaaattcgtcgactccgaggtcttttaatgtcaacggaagaccgacgcctttgataaagtcaataacggtctccaattcttcggccggcgcgttttcaagaacaagctgcgccaaaaggccgaacgtgactttttcgccgtgctgagccctgtgcagagaaggaacggctgtcattccgttgtggatcgcgtgtgcggcggcaagaccgcctgattcggcaccgacgccgcttaaatagatggtcgcctcgattgtatcttcgaccgctcgtgtggaaacgccgtgcttaaccgcctgcatcgctttcacaccgttttccaacagcgtatcatagcaaagacgggcaagtcccaatccagttgttgaaggcttcatcagcacgaggttatcgccgtttgctttaaagcaggcgcgcgcttcaaaatacgtcgccaaggcgtcaccgataccggctgcgaaaaagcgcggcggcgcggatgccaaaatctcagagtccgcaagaacgacatctgggttcgtcggcaaaaacagatagcggtcaaacgatccgtcgtgtttataaatgacggcaagggccgtacatggagcatccgtagaagcaattgtcgggaaaatcacaaccggcagcttctcgtaataagcggtggcttttgcggtatcaagcgttttaccgcctccgatcccaacgatgatattagcgcctgcattgcgtgcaagctcccggttgcgatcgatttcttcctgtgtgcattcgtaattgaatttttcaaaaacggcttgattgccggctttctgaatcgaattccccgcttctttttgagcgcgttccaaaatgaattcatcgcaaatgatatatgcgttgtcgccaaaatcttcaatgtagtcgttcaagttctccagcagtcgttttcctgtaataaattttttaggtgatgtgactgattttactgattttgacatggtaattcccccttcactatcaatgatatacctattttctttttaaatctagtaatatatgtatataaaatggatttttattctatagaattgactaggggaaataaaaagagcctgaagcatcaattttttcagccaaagcaaaaccccggcaaagcggccggggcattgttctttcaaagggtctcaagcatcatagatttttcaaacatcaggtcatcgaggcttttaaatgtataaccttcttttttcaagtcggtgatcgcctgatcaagcgcttcggcattgtctctcgagacggtgtgaagcagatagatggcgccggggtgagcctgtttcatcatattgtcgtacgcatagcgccaccctttttgggcattgattttccaatcgacaaaagcaacagaccagaataccgtttgatagccgagctttttcgtttcttcgagcacccgctcgctgaaaatgccccgaggcggtctcaggtagaggttgtttttttcgcctgtgattttgtaaacctcctcatcgaccgattccaattcctcttgaatgacgcggcttgttttcgtcgtcagatccggatggtgatatgaatgattcccgatgatatgcccctcctcggccattcgcttgatcagctccggctgatctttgacaaaatggcccgtcacaaaaaaggccgctttgacgttttgttttttcagaacatcgagcacctgaggggtgtagccgttttcatagccgttatcaaaggtcagatagatcgttttttcctttgtgttgcccaaataaaaggcgtcgtactgctgtaaaaggttggtcagctcttgacccgcatctgccggctgatggtttttgctttttgaaaaaccccaatggatcgccttgttggaaatcgcttcagcattgccgctgaacgccagcgtcagcaggaatccgcagcatatggcacagattcgtttcatcatcttctcgctcccagttttattttttcttattgtgcagaagggctgagcatttcataccaagcaacacttggaaaacaaaaaaaaccgcggcagagaatgcgcggttttatttccagtcttttttaaagcgctcgtatttggcttccaaatcgtcgagcatgctgatcagtctgtcaatatcttcaaggtcggtcgattccgggtctaaagaatcgatgactgacataaacatatccaatctgtttttcaaataattgacttgctgttctttgtcatgtactgcgttacccatgattctcctccttttgttcctttatcgtagcctataaacggccttttttcaatcatccatgacttgcatgcctcaaggatcaggtctaaaatgaatagttgggctatattagtatgtcctatcataaaggagttagatatgtcatgacagaaaaaatgcaggctcgtccgatcaccccggaatatgatccgtgggaagcctacatggacgttgaccaatttggagatatacagctgacgaacgttgaatttacgacgacgactctttgcaatatgcgctgcgagcactgcgccgtcgggtatacgctccagacgaaggacccggacgcgctgccagtcagccttctgttgaaacggcttgatgagattccccgccttcgttctttaagcattacgggcggcgagccgatgctctcattaaaatctgtaaaggaatatgtcgttcctttattaaaatacgctcatgaacgcggcgtgcggacgcagatcaactcaaacttgacgctcgatatcggccgctacgagctgatcatcccctacctggatgtgcttcatatttcccacaactggggaacggtcgaagactttgcagaaatcggcttcgctatgatggataaaaagccgacgtttgcacagcgggcgcgctatttcgaaaaaatgatcgaaaacagccggacgcttgttgatgaaggggtcatggtctccgccgagacgatgctcaacaaacggacgcttcctcatatcgagcatattcaccggcaaattgtcgaagacatgaaatgccagcgccatgaggtccatccgatgtatccgagcgactttgcaagcgcacttgaatctttaagcttaaaagacatgagaaaagcgatccaccgccttcttgacattcgcgacgaaaatacgtggatgctgttcggcactctgccgttttacgcgtgcagccctgatcctgaagatcacgccctcttacagcggctgcgcgaagcgaaaaacgtcaccgtcagaaacgaccctgacggcagatcgcgcctgaacgtcaatatttttgacggcaatatcatcgtgaccgatttcggagatactccgccgctcggcaacattcagacagacagcctgccaagcgcctacgcgaagtggagaaaaacagagcttgccaaagaactcaactgccactgcccgcacgtccggtgcctcggaccgaatgtgctcgtcaaaaacagctattatcaagatgttgattttacttccagaacagcaagagtatgaaaaaagcaagccgcaaaggcttgcttttttatttcggctgatggctgagctgaaagccgaatgtcaggtgatcctgtacaggaatccaagcgccgattccttgcgaggtgatatttttgacgactagctttcttttgttgccttttaatacgatgtacacttcgccgtaggtgacttttcctttttcattgacggcaggtgcataggcgtgtaaatttcccagttttttcggctgcactttataaatctgatcgcgttttgtaccggagccgaccactgtttcaaaggcgagcggcagctttgttttttccatggctttgagcatcatcatatttttgacatcttccgcctttggaactttcgctgttaagccgcctttgattttgctcgtctgttcctgggaatacgtgagttctgcaggtgctttcccgccccggttgtcaaagcggtttgtgttgattttgcggtattcccagttcgcaacggtttcattcgaggtgtaacctagcgcccatctgcccaaataaatcgtcgcccgatagccgattgccagcggtgtgccggaaatgcttgactcattcagcattttaatcagatgcggattttcaatcgcaatatcggttgttttcagcagctcttcggctaattcgctcggctgcagcctcggctgatcctgagaggcgttagggtatgtgttctctttggaaatattcgtgacagagcttggaatcttgatcggcttggctgcgtcagcttcctgtacagcgaaaaaactaaaggataaaaacgcagtcagcgtaaaacacaaaagctttttcatactatcactctttctgtttctttttccttattgttttccggatgctctctgtttatcccgatttttttaaagaaggaaaaaaccgattcccatgatgatataagcggccagcaatgtcgcgccttcaaaccagttcgtgtccccgtcgttggaaatgatgatcatcaaaaggacggcggaagccatggcgaccagctccggcaaggtaaagacgagcggcatgctcgttggaaaaaacaaagagctgatgacaagaacaggggcgacaaacatcgcgatctgaagcgttgatccgatcgcaatttcaaccgcgacatccattttgtccttataggccataatgacggcggaagcatgctctgccgcgtttccgacgatcgcgacaatgatgaccccgatgaaaagctccgaccagccgaattgttcggccaccgtatcaaacgtatggacgaggtgctcggaaatgtaggcgacggcaacagttgccaaaaataagatcaatgttgcgcgctttcccgaccattccggctcttcatgcgattcttcctgctcattttgattcgtctggtaaaccccgcggtggctgacaagcttgaaataaagtgcagccaggtaaagcaaaatcatgatgatgctgatgccgacgctcatcgacagcttcctcggctctgtcatttcagctgaaaacacttcagggataacgaaagcgacaatcaccgcgaacatgagcagacctgaattgtgtctcgcatcatacacgttgaattcctggcgcttatatttcaggcccccgatgaaaaacgaaagcccggcgaccaggagaaggttgcccaagacagatcctgtcagcgatgcgagcacaattccgatcagtccttcccgcaacgcgaaaatcgaaatgatcagctcaacggcgtttccaaacgtcgcatttaaaaggcctccgatcctcggtcccgcaatgatcgcaaggctttcggtggctcttcccatatagcttgcaagcgcgatgatcgtcaggcagtatatgatgaacaataaaacctgcggccaatgcagaaggctccctgcgacagaaagtggaacacctgcagccatcatccaaaagaaaaaacggctcatttttcattcctcttttcttttttggtgtaggttatttttgtgcgaacttttcgctttatatacggcatactgatctattccgcagcggcgcatgtttttaaacatcagcgaatctcaaatgtttcggtgatgtcaatactgttttcaacagacctcaccatggcgcagtttttcagcgctattctcagcgcctttttgatttgttctgcaccgaggttttctcccttcaatatgaagtgaagatggatgcttttgatgcggccagcctcttcggaaatgcgttcttcttttgtttcgatgatcatatctttcagctgtatccttttcttttccaaaattttacgaagaacggttccgctgcatgccgcaatcgaagcggccagcaattgataaggcctgaatcccgcttcttcattgcttgatattttaagcttcccatattccagatcagcctcaaagccgttctgattccacacgatttccatgaatcacacctcttatgaaagaaaaagaaaaatcgccttgcctgaaaacttctgaaagttgtacgatcaaagaaggattacggataaggagaatcggccgatgactagatttcactttttcattctcgttttgattgtcagtatatcaggtttttcgcaagggatgctccttccggtcatctctgttattttcgaacaggaaggccattcggctgcactgaacgggcttcatgcgacaggcctctacatcggcgtcctgatcgcttcgcctttcatggaagcgccgcttcgcaggctcggttttaaaccgctgattgtcatcggcggggtgatggtgtgcgcgagtttgttcgcctttgtttttattcagtcgtttatcgtttggttctttttgcggctcttgatcggaatcggggatcatatgctgcacttttcaacgcaaacttgggtgaccacattatcgtctgaaaaaaaacgcggccgcaatatctctttgtacggcctttcgtttggtttgggatttgcagccgggccttttttaacgccgcttgtcaacatcgccccatcattgccgtttatcgtctcaggtgcgttcagcctgctggcatggctgtttattttttgcctgcaaaacgatttccctgagaaaagcggctctgaaagccgcagcgataacagcttgaagcgtttcgctcaagccttcctgcttgggtgggtcgcgtttttgccgacattcggctacggctttttggaaaccgccctgaacggcaattttcccgtctatgcgctccggtcgggcatttccgtcgaaggcgtatcgatcattcttccggcttttgcgatcggaagcatcgtctttcagtatccgctcggcgtgttgagcgacaagtacggaaggcgaaatgtactccttgtcatattggctgtcggggcaggctgcttctttgctgcgggcttttccgaatccgttcttctgcttgcggcatgttttttcatagccggaatggctgtgggatcaactttttcactcggcatcagttttatggccgacctgcttccaaaacgccttctcccggccgggaacttgatgtgcggaattacattcagcttcggaagcattttcggtccggttgcaggcgggtggtatatgcagatattccataacagcaacctgttttatttgattacatgcgtgatggtgttgatctggatcggggtgctctttggcaaaacgaagaaaaacggcgctctcgaacaatctgaggcggcgccaatgtaaaaaaggccggctgctggagccggccttttaaggcaatttttaatgatatccgttttgtccgttggcgcttccgctcgttttgttcttcggactttgctttgaattttgtttattatggctgccgccttttttcgtgtgttttgccatgatgatccctccgcttttgaactcatgaaacgttcatatatagattgctcaattccgcggattttcttcaggaatgattttacgcttatgtaaaagggcattgatttcccctccaagaataatcatcattccgcttaaataaaaccagatcatcaggacgatgatgccgccgaggcttccgtatgtcgcactgtagtttgcaaattcgctgacatagtatgagaacaggacgctgacgaggatccagccggcggtcgctgcaacagctcccggaagcacgaatttaaatgacagccgtttattcggagcaaaaaagtacaaagccgtaaagacgatcagcagcacaagcgggctgattccccagcgaagcgctgaccatgccgtcagaaacatctccggcgtaccgtccagattggcgataaaatggccgatggccctcccgaatacaggcagaagaagcgcgaccaatattgtgaaaaccatcgcggcggtcaaaaggagcgatgtcagccgaaccatgataaaagagcggttttcctctacttcataagcatggttaaaggccctgacaatcgcgttcaatccgtttgatgcagaccagagcgccgcaatgatcccgaaagaaagcaggcccctgtttccggtattcagggtctcttcaatgacggacatcgtgtcttctggggcatactgttcgatcagcccgatgacatcgcccgttttgacaggcaggtagccgatcaatgtcaataggaaaatcataaacggaaacagagacaatagaaaaaagtaggcaagttccgccgatttgctcggtccttcatgaaggaaaaaacgccagcccagctctttcaaaaaactcattctttttccggctccgtacgtcctttggatttggctgtgaagtgatccctcgtttcctcaatcaggccgatcacttttggcgtcgtttccttcagctcttttatctgttgatttaagaagctcaaatcatccgatatggaagccgtcagctttttggcttcgtccattttttctttcacgcattcggtgagcatgccgggatttgcacggtaaaggcggactttgtttttgcacgcggtaagctttgcaccgcacgcttccctagtcggtttgtgcagcagtgacataaccgccccgaccgaagcgccgaggaggatatttctgatgaaaacgcggtcgtttttcataaaaaatctctcccttcgtttttatagattgtgttcttttcgaatgtccttcagcaattcgcggcaccctttcgcgacgagttcgtacacctcttcaaagttcccggtgtagtatggatcaggaacatctgccgtctcacagtcttcgacatagtcgagcagcctccggatgacggctttgctcccgtagccggcaaggcttctcacatggcctgcattttcggcatccattgcgatgatataatcgaacgcttccgggtccttgtcagtaatctgccttgcatacaggccttcgcagcttatctttttttcagacagcagcgaccttgtgccttcatgaggcggtttgccgacatgccagcttcctgtgccagccgaatcggcttcgatccggtcctccagtccgctttttttgagcatatcgttaaatacagcttctgccatcggagatcggcaaatattgccgaggcagacaaataacactttgatcatcactcaggagcctcctctattctttccccacttttcagaaagaaaaaacacttttgcttttatactaaagatttttctgtttttttcaactttgggaagaaaagatgacaatgctattgacaaatctaacaaactttcagaatattctagttagacacaaaattaaagggggatatttcgcctatggaatttatttcacatattgtagatacaatgaacggttttttatgggggcctccgcttttgattctcattgttggaacagggatttatttgactttcaggctggcttttttgcaggtcagacttttgccttgctctttaaagctcgccttttcaaggcatcaggataaatcctccgaaggcgatatttcccactttcaggcgctgatgaccgcccttgccgctacggtcggcacagggaatatcgtcggcgtcgcctcagctgttattgccggcgggccgggcgccgtattttggatgtggctcgccgccttcttcggaatggcgacgaaatatgctgaagcggtgcttgctgtcagattccgcgtgaaagataaaaacggcgaaatgtcaggcggtccgatgtattatttggaacacggcctcaagcaaaagtggcttggcgtgttatttgccatattcggggcgcttgccgcttttggaataggcaatatggttcagtcaaattctgtatccggagtcatgagctccactttttccgttcctgcctgggtaaccggcattattgtcacgacttttaccgcccttgtcattctcgggggaattaaaagcatcggcagagtcacctcgctgttcgtgccggtcatggctttattttatgtcatcgccggattgatcattcttgtcacaaactttgaacttgtccccggcgctgtcggtttaattttctctgacgcgtttaccgggcaagccgtggcaggaggcgcgatcggaaccgtgatccgctggggcgtagcgcggggcgtattttcaaatgaagcaggtctcggctcggcgccgatcgccgcagccgcggcaaaaaccgatatgccggcccgccaggcgcttgtctctatgacccaggttttcatcgacacattgattgtctgttcgattacggggatatcaattgtcatgggaaatatgtatctgacagaaaaaaccgatgccctgacatcgatgacattcgcacactttcttggtcctgcgggatcgacaatcgtcgcgatcggactgctgctgttcgcctactcgacgattttgggctggtcgtactacggagaaaaatgcttcacctacctgctgaatgaaaaatatgcgatcgtctatcgtatcatctttgtgatcgccgtctttttcggagcggtctttaaaaatgacttcgtctgggcgcttgccgatatgctgaacggcctgatggcaattccgaacctgatcggcctgctcggtttgacaggcattgtcgtctatgaatccaaacagatcctcgccaaaatcaaagccgaaaaagaagaaaagcaaaacagcgtatctgtttaagccaaatgctttttgacagccgtccttttcttctcgcttaattctgttacaataaagactacgaaatcagtgagaaaggatgtgccttcttgtcagatcaaaaaacagccgagctgaacaaaatgatcgaagagatctcacagaaattaaacatgctgaacatcggcgtcattaaagctgaagacttcagcaatgaaaagcttgaagaccttgaatacctgcaccaaatggtgatgaaaaagaaatctttcagtccgagcgaaatgcaggcaatcgcagaggaactggccgcactccgaaaataaacataaaaaaagaccggaaatctattccggtcttttttcatcagccgagcagcttcaaagattctcgtgtaaacgcagggatgtcgtcaggcgtccggcttgtgacaagctggttctggcagacgacaacttcctcgtccttaaatttgaccccggcgttttccaaatcgacttgaatcgatgtgtagcctgtcgcaccgcgaccgtccagagccttggcggtgattaaaagctgcgggccgtggcagatcgcaaacaccggttttttgtcatccataaaggattttgcaaacgatacgaaacgctggtcggctctaagaatatccggcgaaaatccgcccggaatcaacaatgcgtcaaaatcagccgggctgacttcgtcaatggacgcatctgtttccacttgcgcctcgccttgtttgcctttcagcgttttgcctttttctttttcaataaccgtaagctggtgtccggcgtctttgaacgctttcgcaggctcggtatactccgaatcctcaaagtaatctgtcagaacaactgcaatttttttgctcatattgatcaccctcccagaagcttctgtctacataaatctatttacccctgccacactaaataaaacatccccacgccctcgcgacaaagtacctaagtcacccggcagacagagacagactttggaatcattttctgagtgtttacaatattcgcaacgaaagttctacaaaactttacaaaaagttcttacaatagaaattgttactctaatctgaaaggtggagaaatggtgggaatacagaaaagacggttttcaaggaaaaacattctccgtattctgctaacctcagtgatgatactcagtttactcatgccaaacacccagacatatgcagaagaacaaaacgaacacccgctgatcagcctcagcatcttgggtacgacagatatccacgcccatatgatggattatgactactatgccgacaaagaaacggctgaattcggactggcacgaacggctcagctgatcgaaaagtaccggagccggaatcctaacacgattcttgtcgacaacggcgacttaattcaaggaaaccctctaggggaatacatcttcaaacatgaacgtgaatcgattatctccggaacgaaaacacacccgatcattgatgtcatgaacaaactgcaatatgacgccggcacgctcggaaaccacgaattcaactacggccttgaattccttgacggcacgataaaaggggccgaatttcccatcgtcaatgccaatattaaaacaccggacggaaagaacaaatatacgccatatcatattgaagaccggacggtgacggatgaaagcggccgaaagcaccagcttaaagtcggctatatcggcttcgttccgcctcagattttaacatgggataaaaagcacctggacggcaaaatcacagtgcaggacatcaccgaatcagcgaaagaaacgattccaaaaatgaaacaggaaggcgccgacgtgatcatcgcgatcgcccactccggaattgaaaatggcgaacaggcggcgggagccgaaaacgccgtatacgacctggctctcaagacggaaggaatagatgcgatcatctccggacatcagcacggtctgttccccggcaccgactatcccggtaacggcgtgatcgacaaccaaaaaggaacgatcaacggcattcctgtcgtcatgccgaagaactggggcagccatttaggaattatcgatatgcagcttgaactggacggcggcaaatggaaagtgaaagatgccagcgcaaaaacggaagcgattgccggaaatgtgatgtcgcgaaacgaaaccgtcgtttccgcgattaaagatacgcacgaaaaaacgctcgaatacgtccgcgcgccggttggccaaacagaagctgatattaacagctttttcgcgcaggtaaaagacgatccttcaatccagattgtcacagacgcacaaaaatggtatgcggaagatgtcatgaagggaacggaatacgaaaacctgccgattttatcagcgggcgcgccgttcaaagcaggaggacgcaacggtgctggttattatacaaacattaaagcaggaaaccttgcgatcaaaaacatcggcgatttgtatttgtacgacaatacgctctatatcgtcaaactgacgggaagcgaagtgaaggactggatcgaaatgtcggccgggcagttcaatcagatcgatccttcaaaatcgggtgaacaggcgctcctcaatcccgatttcaggtcgtataatttcgatgtcattgacggtgtgacctaccagatcgatgtcacacagcctgcaaaatacaatgcctcaggcggggtgaaaaatccgcaggcgaaccgcgtcaaacagttgtcttacaacggaaaacccgtccgcgacgaccaggaattccttgtcgtcacaaataattaccgcgcctccgggggcggcggattcccgcatctgactcaggacaaagtcgtttatgcggcggctgatgaaaacaggcaggtgctcatgaactacattatggagaagaaaacggtcaatcccgccgccgacaacaactggtcgatcgctccgattaaaggagccgacgtgacattcgagtcttccctccttgccaaaccgtttgctgaaaaagcgaatgacatcgattttgtcagggaatccgaaaacaaaggatatggcgtctataagctgaactttgacggttcagagcctccagttgatgatgaaaactggacattaaccgtcatgcacacgaacgacacgcatgcccaccttgatggagcggcaaggcgcgctgccaaagtgaaagaaatccgcagtgaaacagaaaacaatgtgctgctcgatgccggcgacgtcttttccggcgatctgtattttacaaaatggaacggactcgccgatttgaaactgatgaacatgatgggctatgacgccatgaccttcggcaaccatgaatttgataaagggcctaaagtgctcgcagactttctcagcggaaactatacagccgtagacccgttaaacagacaccagctggaaaagcccgattttccgatcgtcagctccaatgtggatgtatcaaaagagccgaagctgcgaagctttcagaaagagcctgcagtcttagcagcgggaaaaaagaaagaaagcggcatctatccttatattctgcttgatgtaaacggcgaacaagtcggcgtattcggcttgacgacggaagatacgtcatatacatcaagccccggtccgaacattgcgtttcatgacgcttatcagtcagcagagaaaacggtgaaggaactgaaagaaaaagaaaaggtcaacaaaatcatcgccctcacccacctcggctacaaccgggatctggagcttgccaagaaagtgaagggcatcgatttgattatcggcgggcatacgcatacacttgtcgatcacttgaaagtggtggagaacgaagaaccgacaatcgtcgctcaagtgaaagactacggacagtttttgggaagggtcgatgtggtgtttgatgagaacggcgtcgttcaaacggaccaatcaaggttcaatttgatcgcgatcgacgacaaagtggacgaagaccctcctgggaaagaagtgcttgacggctttaaagaagatattgacgaactgaaaaagaaaaaagtaggctatgccgatgtcccgctggacggaaaacgcgagcatgtccgctcaaaagaaaccaacctcggcaattttatcgcggacggcatgctgaagaaagcaaaacaagccggcggagctgacatcgccatcacaaacggcggcggaatcagaagcggtattgccaaaggcgaaatcacactcggcgatgtgctgacggtcatgccgttcggcaacaccctttatgccgctgatttgacgggggcgcaaatcaaagaagcgcttgagcacggggtgagccaagtcgaagaaggcggaggcgcgtttccgcatgtttcgggtctatccttcacctttacactgagcaagccaaaaggtgagcgaatccttgatgtgaacctagtcaatgacaaaggggacgctgttccgctcgatttggacaaaacctaccgtgtcgctacaaataacttcatgggcggcggcggagacggctattccgtttttaaagaagcgaaaaacggtgtcgatctcggctttaccgattacgacatttttacagagcagcttgccttatacgattctgtttcaccgaacatcgagaacagaatcacagaagtgttccttcccgaccgtcaggcagacggcacttggacgcttgcggaaaagccgttcgaaacatacgggaaaaacgcaaatcaggcgattgcctatttccctgacacagaaaaggaacacatcaagctgaatatgacaaaagcacagactgaccttgtcaaagaaagaaccggtgatccaagcatcaccctgaaaaacgatcgcattgcgatgcagcttccagccgttaatctggcaagcgaaaagacaaaaatcagcattaaaatcgccaaggatatcaaacaggcggtcacaaaggtatatgatttcaacattcagcagaatggtaaaacggtcagcacatttaaagagcctgtcggactgttgttccaagtcgatgctcctgataaacatttgagcgtctattatgtcgaccgcaaaaacaacagcttcacaaaagtaacaaacggctatacgaaaggccgtaccgttgcaggctatgtcgaccatttcagcgagtataccgtgatgaatgacaatgatgccgggtcgccttcccttccgccgggttccggcgatgatgacactccggatggcggcagcggcggtgaaccccctgcttcgcccggcgccggcagcggcggagacggatcaggcggtcatgacagcggcggagcagatgacggaaatgaaccttccgatggttcaaacggcggttttttgcctgacaccgcttcaaacgcctatcattggctgatgctcggcctgctgttgcttatatccggaagcggcctgtacctttaccaaaggaagcggcgcaagctccagatctaaatataaaaagtgcggtctgcttatgcagaaccgcacttttcttattcgacccatttcacgatttgatcaagcgcccgtctcgtcttcggacgcggctctttcacacggtatccgaaagcggccatgaccgagatgtcaaagcggccatcctccaacaccccttctttttcaaggatgtcgtggactttgtcgtagttaaagccttcaatcgggcaggagtcaatgccgatcaaagcggcagccgtcatcatgttggcgagcgcgatgtacgtttgctttgatacccagtcaaacatcgccctgtcgctttcgtacaaatgaaaatcgccgtcttggaaactttccagaacgccgtcttctttcagcatattttcaatgatgtcctccggcatttttttcacatgctttaattgatctgcaacatagccggaatcacgtcgcatttccttagccgtgcgtccgagcagcaaaacgaaatggctggctgtcggaagctgcccctgtgcaccccatgagacttgacgcagtttttcacgcagctctttattttggacgacgacaaattgccacggttcgaggccgaccgagcttggcgacagtctgcccgcttctaaaatgaactgaaaatcctcatctgatatctttctgtccggatcaaattcttttgtcgcatgtctaaattggaatgcgtcaagaatctcttgcttcttggattgctctgtcatattatgttctctccttttctctatagtttatattcctttctcaatttcattctaatcattataatagcaataagaaagtacgcacatttttgtggcatagtatcattttttatactaaggagagaagaaaatgaaaaaacatccggcagcatgcgaagcaccggacggttattcatgtccggtggaagcaacgatcgatatcatcggcggcaaatggaaaagcgtcattctgtatcacttgatcgatgataaaaaacgctttaatgaactgcggcgcttaattcccggcgtgactcagcggatgctgaccctccagcttcgagagcttgagcgcgacggcatcgtctgccgtacaatttacaaacaggttcctccgaaagtcgagtacagtttaaccgagttcggcaagacgctgatcccgatcatccggcaaatgatgaattggggaacgtcctacgccggcaaaatcaaggaagcgcgccaaagatcggcagccgctgaaaaactggaatcgcaaggctaattggccggctcgattttcaagataaagtctttgattttatttaagtattcctcaggattgtggcgaaatccgccgacatgtccggcgccttcaatccagtacagtttcttgaatccctttttcctctcatacaggcttttggccatttccggcggaacaagctgatcctttgtgccgtggatgatcaacagcggcgtgtctgactgctcaaggttgctgaccggcgatatatcagcaaggctccagccgtggcgccgcttgatcagcccgcttgccaacgggatgagaaacggcacggacaatttgacggcggctttcagctgaaagcggcatagctctgttaaatcgctgaagcaggaatcggcaatacaaaacttgattctccgatcctgtttcatcagctcgatggcagccgccgctccgagcgattcgccaagcaccccgatccaaagatctttgccgaacctgttctcaagctcgtcagcccacctcgccaaatcatccttttcgtaaaacccgtaggaaacgtgtgaaccgccgctcaacccgtggcacctgctgtcgcaaagcaggacattgtagccgatggactgaaacagctcgacgtatttatacccgccaaacagcgaccacttgatgccgtgggagatgatgacggctttcctgctcttttgaacgggaaatagcagcgcatgcagccggcatccatcccctgctgtcaaaaacagctcttctttgtcgtgggactcaaacacgtcatcgatgatctcgccgtgtttgagtccgctgaaaaaagtttcttcatatgtgctccggttcggcaaaacaaacaaatagctgacaatcagactgacggcgaaaatactgatcccaatcccagagaccatcaacagaattccgatccacacggccctcacccttttcgttcttgttttaacttattgtattccgaacggatctgggcgtgagtcgctgcagaaaaattgattcaggagcgcccgtttccgagctggatgacttttgcttttccggctgcttccctcagcactcctctcgtatcaaatatcacgtttgcatggtttaataacagctctttcgggagtgcgtcatgatcagttaaaatgacaacacagtcatactctttcagcatctttgaatctatcggcacgcttgctagctttttgccgctgaggtcgaggtccggaacgtgcggatcatggtaggaaacatctgctcccatgccgatcagcttctctataatatcaagcgattttgattcgcggacatccgcgatatttcgtttataggtgacgccgtagattaagatgcgggcgtctgtcgccttgtctttccctgccagctgcaaggagcgctctgcgatatagcggacgattctatcatttgtcgcttccgacagctcgataaagtcgctcgataatccgctttgtttcatgacaaactgcaaatacagcgggtcgacggggatgcaatggccgccgatgccggggcctggataaaaagccgcaaacccatacggcttcgtgcttgccgcctcgatgacttcccacacattcaccccgagcctgtcgcatatcatcgcgaattcattaatgaatgaaatattaataaaccggtacgtattttcgagcagctttgtcagctccgctgtttctggcgatgtaacaggcacaacctcttcataaatgccgctgtataattgatgcaccttttcaaggcatgcatccgtcgctcctcctactaccttcggcacgacctcaatcgggaactgattgcccggatcaacgcgttctggagaataagccaagtaaaaatccttcccgcatacaaggccgcttttttccaggatcggtttgacgatgtctcttgtcgtacccggatatgtcgagctttccaacacgacgagctgcccttttttcaagtgcgctccaatcaattgcgccgctcttttcacataattcaaatcaggacccgcatcatcattcaaaggcgtcggcacgcagatgatgacggcatccgcttcaccgattaaactgtagtccgaaacaggacgaaagaaaccggtgcctattccgtcctgcaccgcttgatcgtttatatccgaaatatagctggttcctttccgcaatgcctcgactttctttttgtccaaatcaacaccgataacccgcattccttttgatatcaacaacatggccaagggcagaccgacaaaccccaagccgatgaccgctatcgtttcgttatgaatttcctgtttgctcatttatcaactcgccccttctgtacattcctttaataaactatgtttcaaatctttttttgaaagggacgatctaccaaaacaaaacctatttatttttcatatcagttgtttgaaatgaagaaagaggcagctgcaccggttgcttctgcagcacagattgatagattccaaagatggtttcaatcgccttttttccttcatagccgtcaaccaatagcgtgtcttggcgcttgagggcgcttataaagttttgatacattgcggtttgttcgccgccgatgtcaatcagctttgccgcttcttcagcatccgccttctccccgtggatgtaccagcggctgatccggtttaatgccggaccttccaatgaaatcgttccattttctccaaaaatcgagagagagcttccgatattgtttggctgtgtgacgatattcgcttctactacacctttcgcctgactggcaaacgtcagaataccgacagcaacatcttccgtttctttagctccggagccgcccagcatatctccgtaaacgccttttacatcacctaaaaaccattgcagcagatcgatcagatgtatcccttgattgaccagcatcccgccgtctttttcccagcttccccgccaggatgccgcttcataataagcgggggacctgtttaagcggagcgataccgtgcccaagtagatctttcccagctttccttcctcaatcgtttccttcagttttttcatgatcggccggtggcgcatctggtggcagaccatgagcttcagcccgttctgctccgccagttctataagctcatcggcatcccgtaatgacaaggtcatcggtttttcgacgatgacgtgcttgcctgccagcagcgcatgtttggccatttcggcgtgcagtcccgaaaccgccgcaataatgaccgcttcaattttaggatctgaaagcagcgcttgatactgcggatagcgggtcattcggctttcctcaccggcgagggaagcatagtattcttccgcttccttcattctttcttcctgcaaatcactgacggccgacaactttgcatcatcgcactcggccagtgcttgaagatgttttcttgacatatagccgcagccgattaaaccaaaatgaaccgtcacttttcccctcctccttttttcagcagcgcagaaataatctgatcttgttcctcggcggctagaaaaggatccatcggaatggcgaaaagggtttcggacaaggactcggctataggaaaatcgccttttttgtactgcagtgaagaatagaccgattgcagatgaaggcagcaaggataatacacacctgaatgaatgtcctgctctttcagcgattgtatgatgtagtcgcggtttttcgcgccgatacaatagagatgatagatatgtgtgcggtcctctttctctgccggcagtgtgaggtgctccgccgttttcaaaccttctctgtagcggctggccactcttcttctttgttcattccagccgtcgattttctcaagaagaatgagtaaagctgcggcgtgtaattcatcaagacggctgttgaaaccgattttgtcatggaagtattttttgctagtgccatgggttctgagtgttcttaattgccgggctgcatccgggtctgaaatcgtcaccattcccccgtctcccaatgttcccaagttttttgtagggaaaaatgaaaaacaggcggcatccccgatgctgccgacaggccgctctttatacgatgcgccgaacgcttggcaggcatcctcaatcacaagcagtccgtgttttttggcaagctccatgatctcgtccatatcagccggctgtccgaagatatggacgggaatgatcgctttagtagcaggggtgatcttttcttctatttttttcggatcaagattgtatgtttcaggatcgacatcagcaaacacaggttcagcccccacccttgagacggcttcggcggtggcgaaaaaagtgaacggggtcgtaatcacttcatcccctttgccgatgccgaaagcttcaagcgtcagcaccaatgcatccgttccgttggcgaccgcgaccgcttcttttacaccaagcttttcagctattcttttctctaattcttcaacctttggccccaatatatattggccgctgtccagcacatgttcaaactcttttaaaatatcctgttttactgtttgaaattgacgttttaaattgactaacgggatcatcctttgttcctcctctaaattcaaaaagttccaaaataagttatgatgcctgccgctaaattggcacggcttgattttattcataaaaaaaagacctacttgttcagtaagtctttacaatgctaattgttaatgcctaatttcccttccagcagctgtttgttatgaaggacggatttgtcttcgggacggtatttcctcgcctcttcattatgatgatacgacttttcaaagtctcctaaattgtaatagcacacacacatttgcaaatgagggtaccaagtatagtatgccggataggtgaagctccatttatttgaatcaggcaccaatgttgtggccagctcataccagtagatagcggccttgtattcccgcctccgctgaaagttatagccgattcttgagcatgtttcggcacgaggcgttttagaaaattcaaatgactggaacagagatctcagctcattgtccatgtcgccgagaaagcggtggcagtcggctttgttgatgcaggcgtatactttgtcttcaatccatccttctttcatttcaatgtttttattgtagctttcaatcgctttttcgtagtgtctgttttctcttaattcattaccgtagtaaaaatagtcgcgcggggtaaacgtgtcgccgcgatcaatcttcttttggtaaatattgaggtttcgtccgacagagtggcggatttttttatgcgtcactgaaatatcggcattgatgatgttcccgaatacctccaaatattgatggcagtcgcctttccatttaaagttcttctcccttttcaccagacggttgcggcggtaccttaatgtcacatttccgaattcgtcggttccagcatcatagtacatagacacggaatcaacggaaggatcaagcgtttccttcaactctttcagttttttctgatcttcttcaagcaaaacatcatccgcatccagatagagaatataatccttagtggcgtgtttgaacgattcattgcgggcagccgcaaaatcgccgatccattcaaagaaaaagacgcggtctgtgtatcgcttcgcaatctctacagttttatctgtcgaccccgtatcaacaatattaatctcatctacaatgtctttcactgtatcaaggcatctcgctaatacttcttcttcatttttgacaatcatacatagactgattgtaaccaaagccttcactccctgagactcttttttaaaatctacccataaaatatgaaacagcagctgatcgcgtttgtgccactatcactgttttatattttcaaggctgcgccatttccaaagtatttttcatagaactttcttttttcgtttgaatatagatactactagcgaaaatgtgtttaaccaggaggtttcagatggataatgaattggaatatctgctagactctgttgggcttagctggagagaaactgaaatatcccaactgatttttcatcacaaatggcacgatgctgcgcagaagcttgaagagaagctgaaagccgctcccttcgatcccggcttgctgataagcgctgcttttgtctgtgaaaaaaagcagcaggctcagagagcgtctgaattatatgatgatgccctcctatttgtcaggcgcgaacatcgacctcgcctcatgaaggagaaagaagaccttttcaaaaaaatggtcaggcgtccaaaaatcatttttttcgtcaaaccggatttggaccggtttttgaattctgtcgttgagcacctttccggaacttaccggacaaaaaaaatcgtggttcatgacctgaatcaaatcgacgctggcatgcaatgggcggatatttgctggtttgaatggtgcgatgatttattgatccacgggagcaaagtcccttctgcagcggctaaaacattaatatgcagactccacagctatgaagcatttactttttatattaaaaaggtatattggcaagcggtggaccaagtgatttttgacggagagcatttgcgggaatacgtattggatcaagtcaaggcgttgaaaaaagagaaaacggccgtcgttccaaatggaatcaagctagatcaatacacttttaaacaaaggcaaaaaggctttcacatcgcttatgtcggctatatcaactataaaaaagggccgatgcttttgctgcaggctttcaaagcactgattgacaaagacccaagatacaaattgtttatcgccgggacgtttcaggacgcccgctatcagttgtatttcaatcaaatgattgatgagctccggctgactgacaacgtccaatttgacggatggcaggatgatatgaatcaatacttggaagataagcattacctgatttgcacgagccttcttgaaagtcagcatatgtcggccatggaagcgatggctaaaggcataaaaccgctgattcacaatttttacggcgcaaagacgatatacgatgaatcagttgtttggaatacaatagatgaattcgtggccatgatcacaagcggtgattatacatctctccattatcggtcgtttattgaagagcattattcatatgacctgagcatgcgcaaaattgaagagatgatttcaggctttgcaaagcagtcagagttgacggttatgccaaatccgccgctgattacggtaggcatcatcaactataattacagtaattttattgatgaatgccttcaatccgttttaaatcaactctaccctaatatcgacattctgatcgttgacgaccattcaactgacggctccatgcaaaaaaccagcagctatcaaaaaacgcatccgcacattcgagcgatatgccacagcgaaaatacaaaacttcctgatctcgcttttaaagaaatcttccaagaggctaaaggcgaatatgttctgcttttaagcgcagatgatttcctcccgcacaatttggtgatccatgactttatgcaatgcttttttgaagaagagggattggattatgtttacggcgaccttttgctcgttgatcaacacgggaaaaatgcgggtctgtggacatatcaagagtatggcgatgaggagctggtgaggacgatttttcaaaggggcggctcaggcattgtcccgatggtgggcatgtttaaagcatcttattatcagcaaaaaggcttcacttggctggttgatccgcaaaagccgcttgcaggggatgtgctgaattgtttagccaatacgaagcgcggctggaagcggcgctatttaaaaaaacctgtattatgctaccgccgccaccaaaaaaacatttcctaccaattgcataaaagaattcaatcgcttgtgtacgtcatggattatattgtgaaagaatttgacgaaagcgtctattttcctcatatcaaatggaaggagcttgaggaaaatcaaagacagtccttgaaatatttcagcatcgggaaaaccttttggagaatggcccggagatacgcacaaaacggatatacccggcatctagaccatgacggcaaaaaagaatgcattcagccgctcctgaacaaaatggatgagtacttccaattaagcctcgcttcagacaatcagtatgaacgatatatgaaaaatattaaaaaaatccagctgatataaaaccttccgttctttggaaggtttttctcttgcactctcgcacaaatacacagtcatatagattcatttatacgtatgatagagcgcacaaagtgttttgtattctgctatttaaaaggagaaattgaatcagcatgatcgatgggaggtcatcatgaaagatttcaaatcagatatcattcattgtctggaacaaaaagagtggaacaaagccatgaagcgcctaaaggagtgggaagccgagggatcgcataacgagcctgacttttattttcttcaagcctctctttctgtttatctcggccatgaccataacgcttggctgtggctctggagagggctagatctttttcctgaaaacagatctttaaatctgctgatgggaaaagtgtgcctgcgcaccggaagggaaaaagaaagcgcagcctatcttcaaaaaggagatggagcagaaaccgcaagcgcgccgaagcttgaccttcctgttgacgaaaaaaccgaacctccggctgggcaaatccgcattttgcaaggcacaatggaaatcgccaatcaaatgaataccttggctaaagggctctcacagcatggcgcgcttgcccacactttaaattactatccgtattatttaaattacgctgccgactacacctggtcattgctgaaagaacgcaatacgcccgccatgaatgcgaagctgagaaggcttgccaatgatctcctgccatcctatgatttgttccattttcatttcggcacaagcttcacgctggacatgtcggattatcccattttaaaacaggctgagaaaccaatggtcatgcatcattggggcagcgatgtgaggctttattcaacattggctaaaacaaatccatacgccgttgttaaaacgaaaaacgaagctcgaattcgataccacctcaaacgaatttcccaatatgtccagcactgcatcgtcgccgatatggagctttacgagtatgtaaaagactattatgagcatgtccacatgattccgaccatgatccagcttgaccgctatactcccgactacaggtcaaatgaaaagccgctcatcgttcatgcccccacctctcccggaataaaaggaacccgccacatccttaaggcggtggaatctttaaaagaaaaatacgattttcattttcacctagtacaaggggtttctcatgaacaggcaaagaaaatctatcaaaaggcggatttgatcattgatcagcttcatatcggaagctacggattatttgccgtcgaatcgatggcaatggggaaacccgttatctgctggatcagtgattttatgaaggatcactatccttccgaactgcctctcataagagcaaatcccgccaacattacagaggtgatagaaagtgtactgaaaaaccgggatatgctgccggaaatcggccagaaaggaagaaagtatgcagaagttcatcatgatatggtgaaaaacagcaaaaaaacattggctgtttatcagtcgctactttcggaatgaagttgaacaactttcccgtcgcgggatttgtatgtcaaaaaaacgaaacaagcaggtgaacaattgatgagcaatatgacagagttatccggccagcatattttcataactggcggagcaggctttatcggatcctctttaataggaaagctgatagagcgcaacagcgtcaccgtatatgacaatttttcaagagactccctccggtataagccttaccgggaccatcctcacttgaaagtggtgcagggagacattttggatttgaacgcgcttaaaaaggcgatccagggggccagccacattgtccacgccgccggcatcgctgggattgacacggtcattcaaaacccggttaaaacgatgcaggtcaacatgatcggttcagccaatctgcttgaagcggctgccggtttaaccgaatgcaaaagggttgtctgtttcagtacaagcgaagtgttcggccaaatcgctttcagagcgcgcgagaccagtcatactgttttaggagcggtgggagaagcccgctggacatatgctgtcagcaaactcgccgaggagcatatggcatatgcctattttaaagaactggggcttccgaccgtcaccgtccgcccttttaatgtttatggaccggaacaagtcggcgaaggcgccatcaaaacgatggttcacagagctctgttggatgagccgatctatattcacggcgatggaacgcaaatccgggcctggtgttacgtagatgacatgatcgacggaattttgcgctgtttgacgatgaaagaagccgtcggagagtctttcaacatcggcaatgaacgcactgtgatcaccgtatacggattggcaagcacgattatcagagttctcggatcaaaatcacaaatcttctttggggagaaaaaagaagccgatattgaactgcgcatccctcaggtcaataaagcaaaagagatgctcggtttcagcgctaaagttgatctggaagaaggcatcagaagaacagctgaaagcattaaaaaaaatttggagcaataagaaaggaggcgcttttgttgaaacaatggaaaagcgaaggaaaaggtgaattcactctttcccagcttgggggctgcggcgaaaacgtcgttatcgaagacggggtccgcatttttcatccggaaaacatctatatcggagataacgtttatatcggccatgacacgattttaaaaggctattataagcatgacctggtcatcggttcaaacagctggatcggacagcaatgttttatacacggtgccggcggggttacaatcggagaatttgcaggaattggtccgaacgtccggatgcatgccgcttaccataccgatcctgataaacccgacagtaccattttgttttcgccgcttacattcgctcctattcatattgaagaaaactgcaacatcgggatcggtgcgtctatcctagcaggcgttacgataggcgcccactccaaaatcggagcaaatgccgtcgtcaatcgcaatattcccccgtacagcatagcagtaggcgtgccggcaaaggtgattaaaaaccgaagaatgaaagatgaggatctctcatgatcagattgatcgagccgtatattacatttgaagaagtgcaagcagaattaaaggagatattttcctctggcatgctgacaaaaggcccttatgtcagaacatttgctgatcatatgagacagtatgtcagtgcaaagcatgcttttttaacaacatcggcaacaacggctttatcgatgtgccttaaaagcctgaacgtgcaacccggagatgaagtaatcgtctcagacttctcgttccccgccactgtcaatgtaatagaagatttaggagccaagccggtttttgccgatgttgatcttgaaacatttaacatgcttccagaagaactggaaagtcaaatcacgtcccgtacaaaagccgttctttttgtagatgctcttggaaacccgacaggcatcaccaacattaagcaaatttgtaaggagtacggcttaccccttgtggatgatgccgcttgtgcgatcggcagcagcgaatacggctgtaaatccggaaaaattgccgatctcacctgtttcagctttcacccaagaaagctgcttacgacaggcgaaggcggggcaattacaaccgaccgggaagagttgaaagactggctttcggtcaaattaaaccatggcgctgccatctctgacggaaaattggattttatagatttcggctacaactacagattatccgatatccaagccgctcttggaattaaacagctccaaaaacttgatgacatcattcatcggagaaaccttcagcagaaagcatatagtgaacagcttgaacccctcggattccaaagtcaacaaatcggtcctaacgttgtacacaacatacaatccgccgttttcaaagttccaaaaaacatcgttcgcgacgaattgattcaatatttgagcgactgccatatagagtcgactttcggaacttattgtttaagcggcactacctattaccgccgcaaatacaggcagattaaaccgaattccatttttctggaacaaaatacgatcacccttccctgccatgatcaagtcaatgtggatcaggtagtctcagccattcaatcatttagccaacgtaaaggctaatcaatcaaaaacatccctttcacaaaatagtgacagggatgtttttttattcttagaaataagcaatagaaaaaaggcagtaaaccataggtttactgccccctgaatcattcgcatagcattccagcgaagttccggaaaaacaaacggaaaatatttgctaatagtcgttaaatattaagcgccggttggacctgtcgggccagttggacctgtcgggccagttggacctgtcgctccggttggacctgttggacctgtcgctcccgttgctccggttggacctgttgctcctgtcgggccggttgctcctgtcgctcccgttgctcccgtcgggccggttgctcccgttgctccggttgggcctgtcgctccggttgctcccgttgctccggttgggcctgtcgctccggttgctcccgttgcgcctgtcgctcccgttggacctgttgggcctgtcgctccggttgctcccgttgcgcctgtcgctcccgttggacctgtcgggccggttgctcccgttgctcctgttggacctgttgctcccgttggacctgttgctcctgtcgggccggttgctcccgttgctcctgttggacctgttgctcctgtcgctccggttgctcccgttgctccggttgctcctgtcgctccggttgctcccgtcgggccggttgctcctgtcgggccggttgctcctgtcgggccggttgctccggttgctcctgtcgctccggttggacctgttgcgcctgtcgctcccgttggacctgtcgggccggttgctccggttggacctgttgcgcctgtcgctccggttgctcccgttgcgcctgtcgctcccgttggacctgtcgggccggttgctcccgttgctccggttgcgccggttgctccggttgcgcctgttgctcccgtcggacctgttgctcctgtcgggccggttgctcctgtcgctccggttgcgccggttgctcccgtcggacctgttgctcctgtcgggccggttgctcccgttggacctgttgcgcctgtcgggccggttgctcccgttgctccggttgctcctgtcgggccggttgctcccgttgctccggttacgcctgtcgggccggttgctcccgttgctccggttggacctgttgctcccgttggacctgtcgggccggttgctcccgttgcgcctgtcgctcccgttggacctgttgctcctgtcgctccggttgctcctgtcgctcctgtggctcccgtcggacctgttgggcctgtcgctccggttgctcccgtcgggccggttgctccagttgggcctgttgggcctgtcgctcccgttggacctgtcgggccggttgctccggttggacctgttgcgcctgtcgctccagttgctcccgttgcgcctgtcgctcccgttggacctgtcgggccggttgctcccgttgctccggttggaccggttgctcccgttgcgcctgtcgggccggttgctcccgttgctccggttgctcctgtcgctccggttgctcccgttgctcccgtcggacctgttgctcctgtcgggccggttgctcctgtcgggccggttgcgcctgttgctcccgtcggacctgttgctcctgtcgggccggttgctcctgtcgggccggttgctcctgtcgctccggttgctcccgttgcgcctgtcgggccggttgctcccgttggacctgttgctcctgtcgggccggttgctcctgtcgctccggttgctcccgttgcgcctgtcgggccggttgctcccgttggacctgttgctcccgtcggaccggttgggccagttgctcctgtcgggccggttgctcccgtcggaccggttgggcctgtcgctcctgtcgggccggttgctcccgtcggacctgttgggcctgtcgctcctgttggaccggttggacctgtcgggccggttgggccggttggacctgtcgggccggttggacctgttcctccgccttctacatctaatagtgctacatcatctacaatgacattcgctgtacctgcctgcggcaaagtattaatcaaaatgaaagccatagtagagccagctggagctggggtcgtcgtttgatagacttcaagccatgtattattttggacaatcggtagtctgttgaacgggatatttaaaaagagaccttggcctaaaaagttaaatgaactatcaaaataagacacttgaatttgcacctgaggcgatggagcaggaaaaccttctttagctagagaaactaaaaattccaatccttctcctgcatctactggaacaaattgtgcaataaaagaagtaacagccccgcccagtaatcttgccgaccaaaaacctgaatgagaaaattgagttgtgacggttgcattttggcctacccagggtggaagtgccccgttttcaaagctgccgtttacaaccaaattttggatcgacatctaggattttacctccctttcactagattagcttcaattcccttttcgagaatgaagctaacatatactatgtctccttgctaagctcggtcacgttattttccatacgattaaaacacatttatagaagttaaatccgagtgaatcaaactatattaactttaaagcaacgttctttcacttaatatgaaacttcaaaaggggaaagctccatttagctttcccccctccctttaagggaaccgaatgagatttaaatctctattaaatgctgcagcggaagtaacatttgaagccgttgttaccgctaccctaactgaataatcaactgttgcggtggcaggaactgtatcaacaattgtgctggctaatggaaacctttgagtgccggcagccgcgagactcctattaaatattcttgtttgaactaaagttcctcctctatatagccttatttcaaaaattatattactgtttgcagtatttacagcttctatagccaatgcataatccaccttaatattttgcccactagtgaccgatacattaggaaccgatacaacagttacttctgtatttaaaggaaccgttggcggattgtaaacagtagtagacccaaatagattgttaaagaatatagcagtttgtggactggctggtcctgttggtcctgttggaccagctgctcccattgttcctgcttcacccggcggacccgttggaccctgtggacctgttgggccggttgctcctgtggttccggtcgctcccgttgggcctgttgctcctgtcactccggttggacctgttgctaaaaatggagcgggtgatgagaatcgaactcacgacatcagcttggaaggctgaggttttaccactaaactacacccgcatcgcgaatatatggcgcgcccgagaggagtcgaacccctaaccttttgatccgtagtcaaacgctctatccaattgagctacgggcgcttcatcaggcgacttaactataatactatgaatatcagttaaagtcaagaagttttttgaagtttttctgccgaatgaatgaagtcttttttgtttcgactttatccattatacacattttaagatttttgtacaccctttaaatgatgaatataatatctgtatttaaaagctgtaacttcgttgtctcagcgacgaataacaatatatcatgcatccaactgatccgtcaacacttttttcattttttatacccctgaaaaaataatgcttacagccattcataataaatgacgctttacttgccttttcatcttatgtgatgttttattgaatgttccccaacttcattacaatatatactgaaccgaactataaaccattaacctcgacagcacttttgcacggtcatttaatgaagcttttattcaagatcttcttttaggatatctaagacgcctccgatacatacaaatatgcaggcagaaatcttcgctataggaaaatttccgcctgcaaacttcaaatgcttcatctatatgctcttatgctctgccgttgagactcgacctgcatgtccctcaacaattcaaatggtcacccgctgattttagcgcttgcaccgctttgtgctgtttccgatttatagttgcggaaattatgctcaagctgttcaagcgtgaggccttttgtttcaggaaggaattttttcacgaatgcaatggaaagaagtccaagtccgacaaaaatgtagaatgtcgaggacagcccaatcgattcaagcagtatcggaaacgagaatccgacaaagaaattggcgatccacaaacaaaacacggtgacgcccatcccgaggccgcgtacgcgaagcgggaatatttcagaaagcatgagccatgttacaggagaaatggcgccttgttggaatgcaaggaaggttacagtcagcgtaagtacgacataaggaagagcagctgaaccttgaaggacgtttgagaagatgccgataagcagcaaagctgatgtcgttcctattaaaccggtcaacagcatcggtctgcgtcccacttttcctaaaagccaaatccccacgaacgtcgccaatactgaaatgacaccgtttgcaatattgccgatgagtgcagctttagtttcaaacccggcatttttaagaatttctgttccgtaatacataatagagtttacaccggtaatctgctgaacgacagcgataccgattccaagaaatacgattcggcgcacccaaggaacagccaggtccttataattcgcttttttcatttccgattctttcatgactgcagcttcgatttcagcaacttccgaatgcgcccttttttccttgcggattcttttcagaacacccagcgccgcttcatttttccctttagagacaagccatcgcggactttcgggcattctcagcataccaaagaacaagaatacagccgggactgcggcaatggccagcatgtaacgccaaacatgtgaggaatcgcccattgtggttccgaggatggcattgaaggtaaatgccaaaagctgtccggagacaatcattaattcattttgggtaaccattcgtccccttttttctgaaggagacatttcagccaagtaagtcgggactgtaacagatgctcctcctacggcaactccgagcaggaaccgtgagataaccataaccgtcacatcaggcgcaagcgtacatccaagcgtcgagaaaaagaaaagtacagctagaaaaatgatgttcttgcggcgtccgatataatcggatagccttccgccgaacaccgctcccaatgcggctcccaggagaagcgaactcgcgaccaatccttctgtaaatgctgtcaggttcagctgatctccttcagacatataaggcaaggctccgttgattactccggtatcatacccgaatagaagcccgccgaacgtcgagactaaaataatagtacgcaaaaatgatttctgatttccctgttcattcatattgatttcccccgcctttgtttaaatgaaaattgatttatttccaaaggttttcgaaacatccttaatagtagctcatttctttttcctaaaagcttcatatctaacttttgaaagtttcgccccaagcaacccctccttaacagaaaattaaaaattttattttgatggaagctgaagcctccttgcaaccaattacccgcaacggaatattttggaatcgcattcatttctattccgtttaaataaattgttaggttatagttatgtttttggtacatctttgttagatctgatattatcataattttcaaagcgctttcagtcaatataaatttcagaaaacttatctattttcattgagtaaaatcgccgccaaccccggtatgaaagaaaaatatccaatccgcatcgtttcattttctttttttgttatttctcattacttttttactcttgtcatttcatagtgatctttttgtcatttttttgtgatgtatagaattttagtcccaataaaaaaataccaaggggcaatccctcagtatttttgcctgcctgcagcggacattcaattatctgtgtacagcaacatgaatcagctttcctttgacagcaaggcgtccttcggttctcacagctttgtcacatgtaatcagtgtaatttccttttttttcgtctcttgaatcacatctgtgtccatttcagaaatgaattgtttcgacgtcacagcgtatatatagtcttttttaaagtctgtgattttaacggtatctcctttttcaatgttgagaaggggaccgaataagaggctctcccgcttcatatgatggcctgccagcgggtagttgccttcgcccattttctgatcgggtcgcattgttgtcgctccgtaaagaagattttgattggttgtgcccttcaatatcggaagcttgagattgacgctgcttatggtgatccggccgatgaccgcttttgattcacgatcgaggctggcttttattgtttccaaaatagaaggcggctgaatcgcctcaaaatcaaatgaagccttttgtgcattgttttgttccgcctgttcagcagtcaaatcaaaatttttattcttgttgagattgatgatgatgctttctttaatgaaaggagacaagacgaagagtattcctgatatgacaagcacggcaacgatcatttttttatacatgcctcacagtcctttctttaaaaaagcacctgaccggttcaatgatcaggtgcttcaatgattcgtttacgcctttctttgtttctttcttgtgaagaaagcgaaggctcctccagacagaatcagcaggatgccgatcatgatcggaatgatgctgtctgtgtcaccggttttcggaagcgtatctttcaaatgaccgttgtcatttgttttaggatctcctttcgaatttcggtccggtgtgcctttgttatctgttttagggtctcccgaattcgggtccggtgcgcctttatcaacagccggcgttttcagtttttcattggacgcgatcacctcgaccggttttgtctgtccttttttaatttcaaaaggaatcggtgtttcatccagcttgtaaccgtcaggagccttcgtttcgacaaattgatagcgtccaggtgccaatccctccgctgtgaactgcccgttttggtctgtagtccagactgccggcagctttttgctgttgcctccggctttaactggctttccatcggcatcgagcagtttgaattcggctccttttaaaacagcctttttattgttgctgtccactttcgtcagtttcacatcgccaggtgtcaattggttctctgcagtcagttcgatttgctttgtatcagtatttttgactgtgaacgatattggcgtcttatccaattgataatgcttaggcgcttttgtttcgacaaattggtagttaccgggcttaagaccgtacactgtgatccggccgtctgcgtctgttgccaaaccggttttcagcaccttgccggtttcatctgtcaaaacgaactgcgctccctgaagtccggcgctcttgtcatcctggccgacttttgtgagcacaacgctgtttttcttgttgagagccgtcagtttaacctgtttcggctcaccttcgtgtttcccggtaatggaaaatgggatcggatctgttgacagcaggtagccgtcaggcgcatgtttttcaacaaattgatagcttcccggcgccaaatcgccagcctcgattttgccgccttctttagagatcaaatcgtctttgaccgttttgccttcgctgtcaatgattttaaacacggctccttctaatccattgccgtcttcatcttctttctgcaaataaaccgaacctttgtagttgatggctttacccgcatctacatgcgcaggttttccttcagcggcatccgggatgacaaactctattttcccgctgttcaatacaaatccatcaggcgctttcgtttctacgaaagcatagcgcccaggcgccaggcctgaagccgtaacagttccatttcgatctgagaccagttcctcctgtacggtattcccgatttgatctgcgatcttaaaaacggctccttcaagcttgtggcctttcgcatcttcttttgttaaatgaaccgagcctttataattaacagcggcgcctgcatcaaccggctccggtttcccttcagctgagcccgggatggtgaattctatttgatcgttgtttaacataaagccctcgggcgccttcgtttccacgaaagcatagcgcccaggcgccaggcctgaaactgcgatttttccgtcttcatcggaagtgagcttttcatgaacggttttgccttcatgatcaacgatcttaaactcagcgcccttcagcgtacggccttccgcatcctcttttgtcaaataaaccgaacctttatagttgacggctttgcctgcgtccacggattccggtttttcttttgccgattcagatatggtaaactcgattgccttgctgtttatcacatagccctcgggcgctttggtttcaacaaaggcatagcggccaggcgcaaggtcagataccgcggttttcccgtcttgatctgaggtgagcttttcatgaatggttttgccttcatgatcaatgagcttgaattcagccccctctaattgacggccttctgcatcttctttcgttaaatgtgctctgcctttatagttgatcaatgttcctaaatcaacgtcaggtacttgattcttatcattcgttttgacggagaagccgagttcttttgtatttaagagataaccttcaggcgctttcgtttccagcaaacgataatcgccgggcggcaaaccgttgatctcaacttttccgtttttgtcgctcttaatatttgtacgtattgtcgtaaaggcgccatcgccggattttttctccagcttgaacacggctccttccaacggattcttttgttcgtcttgtttgataagcgtcaccttattcttctcattcacgactttgtaaagcgctccggcacttgaagagctgctgttaatctcaacggagaccccgtctgcataggcgtcgctgatcgtatatccgtcaggcgccttgatttcttttaaaatgtaagtgccatagcgaatattgccgaatgtcagcttgccgttgtcgtcagtcgttcctgtccgcaggagctgctcattatcttttgtccgcaattgaaaatctgctccggaaagcggcgtcccgtcttctcccgttttaaggattgtcaggcttcctctttcccctgagcctgaaccgccgccgcttgaaacggcaacaaagaccgagctgttgttttcctgggtctgttcctggacattcgttcccgaaatcgacactttgttgttaacatggccgctcgtgccggcaatattgatcaatgattgatattgaataacataggcgcggtcgatttttttgtaatcgcctgtaaatttcaggacaaatgattgttcgccggttgcattgtcggtcttgatatccagtgtatagtcctcgcctttcttaagctgaacatcatccgggacaagatttccgctgctgtctttgactgcacctttttcatcatatttagcctgataaactttaaaagaatcttcagctaaaatttgattggtatccggagtatcggtgacttttacatcttccaacaccgactggctcgcgttgacattgatgctccaatcgacataacctccgttttgtttgcctcctttgaaaacgaggcttcctccgtctgcgaccgaaacggatgccgtcaactcacgctctgaatatccggcattatggtacgtggccttattggtgtaaggatcgtgcttaatgacctgtccttttagcgatgttttaaattcaataagatacgggacggaatcgtccgttttcaaatggacggtcaaagtttgtttattggcagccgacggctcttccacatcatattgggaggcgggcaggatgtctccttctgtgatggaaccgtctttattaactgaatagctcttgacgacaaccgagcctttttcaaattgctggtcatctgctaaagaatctttaatataagggttttttgacggctctccattatagttgatgccgattttccacgtgatttcttttgaaacagcgttgtataagccgtgtttgaagccgttgtgggatgtctggcgattcggcgtaaaactgctcgcttccttatttttgcgttcagtgctgctgtgatcagtccacgttgattctgccgtgtttttgacattttcgttggaaaagtcggcattcatattcgtggtatacgtgatcttaagctggctgttcgttgtcgcataatctccgatgagttccaggagaaaaccttcatgatccggttttattatcaatgtatagtctttgccttcttcaagcgttttgttattcgtcacatcctgaaggcggaatgatccgtcgaggagcgtgagcccgccgctttcgaaattgtcatccaacttccaattgttcatcgtgtagttgtttttgttgattgcgatcgtccaatcgaccgttttcttcttgtaatcaatgtttgagtagccttttatcaaattctgctgaacggctgtacctgaagctttctttgattctcctgttccggtcactgcagtgttcgtataggttgttgatttatcgatgattactccgctgttgacctcggtttgatacgtgattttgtaagctccggtaacatcttggttaaatttgatttcaaacccgcttccattatcagagagcgtataatccttgccttccgttagaggcgttccagcctgctcactgccgttctgattgaaagtaatcggaatcacctttaaggaatctgaaacaagatgcaaatcagcggaaccaaacgagtctgttatgctcgctttggattcgtcgatttttttctctccatagttatataaaatcgtccagctgaacgtctgtgaatcgcttttataacctgtcgacgatttttcgatcattttcccgtatttggccgtgacagaggcctctgcagaagccggttccagattgtctccgccgaacgttgccttgttcctaaatgcagcgtttccgccttcgttcggttttgcggagtcatcgatgtccgtcacatagatgaggcggtaagccgaatctatctcaccgtcgaatgtgacatttccatctgcgtctacggtgtagcctgaaagaacttcatctccccggctgactgaaccatctatgttgacatccagctgataaactttgacagaacgataggtcagcccctctggaaagttctgcagcttggcatttttcacctgatccaattttttgttgaggtcgactgtccatgtgacctgcccggggttgatgcctttatcgaaagttcctgatttatcaatggttttgcttacttttggtttgaaataaaccgttacttccggagtgtctgatttcaccggaaaaggaatcttttgagtcgtcgagccttttattttttgtgcgttgaactgggtgttgacaaacaacgtccctttgacattcgaatcttctttcacttcgccgttaaacgtcatcacaacgtggccttttgtatcaattgaaaaatagccgtacgtgatgccgtctgagcttaatggctgattcgtaatgtcgttgtacatgataaaagcttcaggcagatcaaattcatagcggtcgccgtcgtttatcgtctttccgagctcattcgggatgtcccaagtaattgagattttcgccggagaattcgtgtcggctcgattgcttttgtcataaggctttccgtgctcatccgtcagcgtcacgccggttaaaatattttgggtgatttgattgccaccggacgcaaggcttccggctgccgccagtctggaagatgccgccggttttgaatcgctgttctcagcgtcggcagcttttttcttcgtttcctcttggtcctgtcctcctgaagattttgattgatcgtctgactgatcgtcctcagatgacggaggatcatttttcgccgtttccgattcggagcctgtattcacgggtatgatcacttgctgtgtcttgcctgctccgagttgaaagagagctgtgaccgtttttgtatcgcttttcatatctgcggcaaactttgctgacagcgcaatggccccttttgctccggcagagccctcggcagggctttttagagttacggtaaaaatgttgctgtccgctttcacttgatagctgccgatgatctgctgatctgccgatttcacttctccctcggcatcctgagcgaattcgaagcttttaggtacctctacagtgaaactgttttcggcgccggcttcttcatcgttttttaacgaccactcgtatgtgagtgtcactttgtctcccggctttaatgctggttcgtctccctttgagccgtcaaccgtttgatcttcgctgtttttgattgtcactgaatcaaaaaacacgctgccgcctgttgatgtgccggtagccactgccgtcagcgtaaagccgacaacttgactgaagatcaaatacaatgccaggcaagtgaccaaaaatgatttcagccctctttttttgctgaggctgaacgaatattttttcgatctcaaattgtgattcctccccttttataatgtttttgtgtacggatcgattgagcctggaaatggacggcctccctcctgaaaatttttttctatttgcagaatgacaggcttttaaaatcgttgctgtatgtttagcggcggtagtcaagatgtcgcgggtatgaattttgctttatgtcagctgacatcatccgaaccaaactacattgtatgggatggaactatacaatttctgaacatcgaaatgtaagctgaaaatggcataaaaaaagaccggctgatccggtctcgcgtttacctttaattcattttgtccttcataagtttatagcgctcatattccttgatcgcttcttctacattcccggttttattaaacagctgcatcttgtattggatgattttatgatcgcacggttcgattttctcgaccagcagacatatatcaagcccccggcggtagtctttttcatgaataagaaaatcgaccagttcataagcttttccaagccagatccgggcaagccgcgtcttttcgggttcggcccacaaataaccgtgttccataaagtaatggttttcgtatgcaagcagcaattccatgtgcctgttgatcgtcgccatatggatgggaggagcctctttcagcgacttttcccattcgtcagcatccactttcacaccggaaatccggaggacatatcctgtgtcagtcttctcgatggattgaccgaaaggaagcctatcgattaatttcctgatttgataaatcgctgaatatagctgagtgcttgctttagagacatcatgatcctgccagaacaggtcgatcagcacgtctttgctgatcacatggccgtgatgatgaagcaaatacgcgtaaatttcacgggccttggatgttctccacttaacaggtatatatgttttgacgcccttctctgctttgtaaaattgcaaattcccaaaacattggatgaaatagtcccctccggcatttaccgctgaagcctttagcaagctgttttccctgatccgttcaaccgtcttcacgagccggacgtaatcgacgggtttaagcaaataatccaccgcatttaattcaaacgcttttatggcaaaatcgttataagccgtgataaaaacaacctgaatgttttcattcatcgattgaatcgcttcagcgagctcaatcccgtttatccccggcatttcaatgtcaagaaacaccgtgtctatatcccgaatatccggatattccagaacatcagccggatcttgaaacatttcaatgaatcgaaagcaatttgttcgttcaagcatatttttaaaatgaagcaatgccagttcctcgtcatccacaattaacgctttcacgacacacccaccccatttttcatcgaatcatctggaaattatgataatgattatatcatgtctacggacctatttagttggattcattttcttaatcttgtcgtttattaacatttaagagtacaatattcataagattcgacaagactgcagcaggtggaatgaggagtgctcatgttgaaaaagctatttgttttcatttcgattattctcggctatgccggcttcttttttattttcttattcattaacaaccaattgtccgagcaaaactaccctgaagcgaagcaaggaatcatcaatctggaaacatgggattttcagaaagacgggaacatcgcgctcaccggagaatgggcactataccgaaaccagcttctctccccaaaggacattcatgcaggcaaaggaaaagcccccatttattccgatgtgcctaacaatgtcaaacttaccgattcaggaaaaaacgtggattacggtacatacagactgatgatccggtcaaagcaagacaatgagatgttcggaatcagcacctcttttataaacagcgcaaaccgagtttatttcaacggcaaattgatcgggcagagcggaaccccttcaaacaaagcgaatttcacggcgcaaaacaggccttatacgagttttttcgaggttcgccgcggagacaacgagttgattgtacaattttcgaacttcaaaaaaacaccttcatgggggatagaaaaaccgattgcctttgggatgcagcagcacattttacaccaaagcaaaatctcttttttaaatgaaaccagcatgatcacagcattctttattaccggtttatactttctcggcttttttctgcatcgaagaaaggataagcacttattctttttttccacgatgtgtcttcttttttcggtcatagtgcttttaatcggaagagaacgaatgatctttcttctctttccgtctatctcattctcagctttaagcgtcgtgagggcgaccacaatggtgcttgtcagtatggcggtttttctctatctatatttcgcttacaaagaaatcgtttcgaaaaaatggataatcgccgcgactgcattttctgtactggttttgatgattgattttattacctggggttacacagaccgtctcgcatatatattgcactctgttcttgccgtcacgactttgatttatattacgtatgtgtttgcgatttctgctgttcggaaaatgaaaggcagcctttatcttacgattgcagcgatctcgatgagcgcattcgtcattttaacgacagtttctgcttacagcggcaaaagaggcttttcattcaattcgctctatgccgtgccgtcgatcatcgctttgctggcggctgtactgatgatggcgcagcaattcgcaggcgcattccgcgagaacgaaatcctgtccttgaaattgctcagaatgaatcgattaaaagacgagtttatcgccaaaacatcacatgaatttaaaacgccgctgaacagcatgattaatatatgccagacccttttggcaaggaagagaaaaaggacgttagaggaagaaaaagaaaatctgcagctggtcatccgcatgggatacagactctccagtctggtgaacgacattctcgatttggaaaaaatgaagcagggcatgctgcagattcaggccgttcctgtcgatgcccattcggcgatcagcacggaaatggacttctatcggctgttgtcaaaaaataaaaatgtccggattgtaaaccgtgttccatccggactgccgctcgtcttggccgacgaaaaccgcttccggcaaatcatgaccaacctggttgataacgcgatcaagtatacgccggaggggcagattacgctctccgccgaaaggctcgaccaagagaaggtcaaaattacagtagcagatacaggagtcggcataccaaaagccgtgcgtcaattgatattcgaagcttttcaacaagcaaaaaaccataaagacgacggagccgggcttggtttaagcatcgtcagacagctcgttcagcttcaaaatggagagatctgggtagaatcggaagaagggaaaggatcggcatttcatttcacactgcctgttgcaaaaaatgaccctcttcctgacgcgaagaaggagaacatgcctcaacagcaagccgtcagagatctgcccgatgtttctatcagcacgccgtactactcaaagaaaatggatgcttcaactgttttgatcgtcgatgataacatcgaaagcttaaaaattttggccgatatgcttgaaggcgttccttatcaagtcatcgcagcaaaaagcggccatgaggctctcgaagtcgtctcccgttcaaagcttgacttggtgattttggacctgatgatgccggatatgacagggtttgaagtctgcatgaaaatccgcgaaaggttcacaatggtggaacttccggttctgatcattacggcagccatcatcgaccatgataaatacaaggcttttcacgctggggcaaatgacattttgcagaaaccgtacaactacactgaatttgcagcccgcgttaaaaacctgatcatgatgaaagatacggcagcccaagcgacaaatatggagatggcattcctccaatcgcagatcaagccgcactttcttttcaatgtattaaataccattatcgcgctcagtcatttggatattgaaaaggcgcgcgaagtgacggctgattttacaaactacttgagaatgagttttgactttcaaaatacatcagggatgagttctttcaagcatgaactgtcgattgtgaattcgtatctttccattgaaaaaacgcgcttcggcgatcggctggacgtcatttacgatattgaggaagacatcgactttacccttccgcctttaatgattcagcctcttgtcgagaatgccgtccaccatggcatcagcaagaaaagaggcggaggctggatcaagctgacggcaaaaaaagaaagcgaaaaccgctattatatcaagatagaggacaacggaatcggcatgccgccggagaaacaacaagatatcttttcttctcatttcactcatagtgtcggtatgaaaaatatcaaccgcaggctgaaacacttctgcggaagtgaactgaatatcgaaagtacgcctgatagcgggaccgctgtctcaatggtcatttctatcaatgaatccgcggacgtctcagactccgccatccagcgggcgcctctataacaacaaaaggacggaatcaagtgattccgtcctttacctttaccgctccccctggttttcccgcgttaaagcaaaaaaagcgaaagagccgatcacagcagtgatgaacatgatcgcacccattggaacggccgttgtttcattcattccaacgagaggcgaaacgatcgaaccgagcagcagcggaagcatgcccagcattgcgcttgcactgcccgcacggtgcccctggttttccatcgccagcgtaaatgtgcttgtcaacgtcattccgatggttatcatgtagataaagattgaaatgacaatcgctgcaagcggtcctttcaaaatcgtcatcgtcaggagaacggatgtcgcgatgacagcggtaatgaccgcgatccgcaagagcttcctctcatgaatgattcccccgaatcgcccgatgataaagcttcccgaaataatggcgaggccgttaatgccgaacagcacgctgaacacctgaggagaaaccccatagatatcctgatatacaaaaggcgttccggatacgtaggcaaagctgcctccgtgaatgaaaccgacagtcagcgcatagccgataaaagaccgatccttcaacaagctccccatcgttttgagagacgaaccgattgagcttggaatccgtttttcgggcggcaatgtttcagtcaatttcatcgagataacgagtactagtaacaatccgatcaatgccagcgtataaaaaatcgtatgccaagtagcgaacggcaaaagcaggatggctccccccgtcatcggcgcgaccatcggcgcaaccgcggtgataaccattagaagcgagaaaaatttagaaagctctctccctgtaaacacgtcccgtacaatggcgcgcgacagcacaattccagccgaagcggtaaatccctgtaaaaaacgggcaagcactaatgtcgcgatattaggcgacagcgcgcaaaacagtgaagacagcgcaaacagcgaaatcgaaattaataaaggttttcgccttcccttcgcatcgctcacaggcccaatcacgagctggccgatggtaaggccgatcaagcaagccgttaagctgagctgcacaagcgacgcaccggctcccaggtcatccgctatttcagggaagctcggcaaatacatatcgatattaagaggtccaagtatggcaagcattccgagcagaaaagccaatgccaacctctcttttccaactggattatgaagcataaaaacatcaaaacctttctatcaacctagttaacatctctgtttctattgttacaggctgcaaaacatttgtatattgtaccatattttttgaacagtgaaaggcggttgcatgaaaaataaatgcacccaattgactttattgccataaaaaaaggcctccttaaaggagagcctctttttatagattatttcatcgctttgacgataagcgatgccaaggcttcagcacctttcggcatcaggtggacgccgtcggcggtgaaatattcgggatgttgcagtgcttcagcgtgccaatcgaccaatgtcacattttgacggctgtccgcatgcttccgaagcgattcattcaccttgctctcccattgtcgggggacgcgcgtattcacgagatagacatccgcttttgagaaagcatcaagcaaagcgtccaattggccgtccgtaaaatagccgtttgttcccaattcaatgacgacggctttgtccggatgattaaaggaggcgtaggttgatgtcaattgaagcgcttccctcacttgccttccaacctgtccgtcgattgtgattcccggaatcttccggcgcaggcttgaagcgatgtccagcatgaccgaatccccgacagccaatacttctttttcgatgcgatccggctctttttccgcagactgctcatctttcgtatctgacgattcctccccgtttccggttttactctcatttccgctctcagtttgtgctttcttatcgtcctgccgttcttcacttttgtcagccggctgatccgctgaggcgcttgtttcctcataagattttgaataggcctgctgcggctgtttcttttcgtcggccaatcccgacagaccccctgcaaaaacgaggagcgcggcaaacatcaggccgattgatattttgcttggaacggaagccgttttccattccgtgatcttatccagaaaaacccggctgacaaacggtttaaaaccgtcttttcggatcggcttctcaataaagcgatacgaaagttccgccagaataaatgtaacggcgaccttcatcgcaacatgccagtacaccggatttccaatctcctgaacaggcgtgctcagcacgataacgggatagtgccaaagataaatgccgtacgaccttttcccgatccagcgcagcggcttcacggaaagggcaaagcccaggaagctgctcggatgactgacgcatgcaatcaaaatagctgcgattatgctgattataagcattccgccgtgatagagaaacgggctgaattcatcgacaaaataaatgcacatcataagcagcgcgaaagcggcaagctcagttccgtgcaatgcatgcttgaggctgttggggagcctgttcccagacagccttttcatcggccacacaagggctaatgcgcatccgatcaacagctcgaaagcgcgtgtatccgtcccgtaatatacacggctcggatcgccgcccgggacgtacaggatgctcatccatatggctgaacaaagcgcacacagcacaaccgccgctgcaaacctctcccgctttttaaatatgtagatgcccaacagcaaaatgatcggccagataaaataaaactgttcttcaatcgccagtgaccacaagttttttaaaggagacggcgatccgaaactatcaaaatatgacaggtcgtgaaagataaaccaccaattgctgacatacaaaagagaggagatcgcatctccccgtacggtatgcatcagctctctgttaaacaaagcgacccatatgacggttgcgaaaatcatgagcgtcgccgctggaagcagccgccgtatccggcgcacccaaaaatcgcggaatgtgagggaaatgtcatttccatacgccggcaggataatcgatgtaatcaaatatcctgataaaacaaaaaagatatcaaccccaatgaagcctccgtcggcccagctcatgttgaggtggtaagcgataaccgccaaaacggcaaaagcccgaaggccgtctaaccccggtatgtaacggtgttgttgtgtctgatctcgcatggtattcctccaatgatatgtacgtacgattcttctgtatgtttcgtgccttttacggctccgatattatagacgaagtcaggacggttttttgtttcaaaaaatcgtcatttttatcttccctgagtaatgccgtctctctagtataagagtttcctgcagaatatgttgttacaaagttgtaaaaaaataagaaatccatgatttcagcgaatcatggatttctttcactagcggatatagcggtcgccgatcagcaggttcgaaatcgccttagtcggaatttcaaactccaccgcgcccatatagccgggagcgacttcataatcatcaaacgaaatcaccagtttatgattctctgtaatgtaaaaattttggtcggccttgattcgtttgaatggctcgacttcttcgtcaccgatccaatatattttatcaggatcatctttcatttgctgtttcatttgctctttaatgttttcgctgatggcggtgatataccggtcgtctttaaacaagcttttcaaggtgagcaggacttcattctttttgtcaatggtgatatagcgccgttcggtatagctggacgcttccgttctttcgacgcttcgccgaatcgaaatcaaatctttcgtatccgtgactgtctcataatcgctgtagatgctgagatgcccttttttattccgggacgtctccttcatgaattcccggtaaagctgatggctttcctttacatatttctcgttgatgccattttcgagctcccggttattcaagccggaaagagccggtgttttcacgtcaatgctcgattctccatctttctgtttgatctcggtgaatgtgatggctttaacgaccttgccgatgacaggtatctgcgacatggcctgcgctgctccgggattgatattcacgacggcagccaatagtacagccgccgcgaccagcgttgatgcgggccataccactatccttctcttcttcttcggtttatgctgaagcgcagtctcgacaacctgatccagctccttcggaatggggacgttttgatatgcttttctcagctgttccaatttcttatccattaagaaagatcctccttcgtcaattggatgcgcataagcttcaatcctctgtaaaggcgcgttttgatcgtattcaagttttcgcctgtgatttccgctatctcttccagtttgagatcctcgaaaaaccgcagaacaataatggtatggtagggttgcggcaactcatcaagcgcctcatggagatctgtatcccggtaggtatcttccttgccctggcttaaaaactcgatcgtttgatcatccataacctttagttttttctgtttgcgcaaaaaatcgattgccgtccgcaccaaaattttataaaaccagcttttgatcgtatccggattgcgaacggaatcgacggaatcgagcgcttttttgattgattcctggacaatatctaaggcgtcttcttgatttttcacatagctgtatgccagccggtaaaagtcttctttccggtctgttatgcaagcgacaagagacgctctggctgcttgtttcttcattgcaataaagaactcctttttcgaatatacgtatatacggctgttacattaggatagacgcgggagtgcgaaaaatagtttgcggaaagacgtgttttttttaaagaaaacatcacttcatttattctaccctgaaaaataccggaaagggaggcgaaggaaattgagtcgccagaatgccggtttgcgcaaatcaatgatgagaaacaaaaaaagagcaaaccatatataaaggtttgctccgtagcccttgctcccttttagcggatagagaaaaaaaacaccgatataaacctcgcgagaaactgattttgtatattgaaataatccgaatcgaaattctaaaaaatatcctcaaacaatgcggcaaacaaaccaaaaaaacaagcgaacaaaaacttgagaataaataaaactgcaacggcgatccatgaagcccgtttcgaagctccacccgctttctgaagaccttcagccgctaacacaagcgcccaaaccataaagatatcaaacacgcccaatatgcttttataaggctcgacggccgaaaaaacatcgtgcaaagatgtaaacgaagtcccttccggcacattcgcaaaacgataaactgtattgtttatcacgtcgccaatgattttggcaaagcctacaaaagacgccaacgaaaacatcgtcacaaagtttgtttttccgccccctattgtcgcgatcagccataatattaaagctgatacaaacaaatagatccccgtctttaaaaactcccataaaaatatgatcattccaaagtaggtatacgtatcgggaaaatcttttgaaatataaagataagcagataaaaccgataaaacgaatacaataaacatcggcagagcaaccgccggccgccttttcattctttcaaactgcaatgccgggttcgtgatcaagccgattaatgaaggcatcggctcttttgtttcaattctgtcatccatgcttctattcctccatatacggtatccttcaaagtttacatgactgaccttaaacccagcttaaacttacataaaaataagagatcaagagaaaaatggttcctgccgcaacagttatagccctgtacttgtttgtaagagctaaaaaaacagaatgccaagggctcaaatacccttggcacagcgaattatctataccttatcgaatccagctgtatgcaaaatgtccaccgcttttctgcgtgtaaaatgaatgacgaactcagctgccgccacgttcagtgcaatcgccccgtaaacgcctatcgtgtagctgatatcgtatggcaaaccgaatccgcttcggcacacaaacgtgatgaaatgaataaacagattggtaaaacagaatagatagctgcgaatcatccaattccgatgctttgtaaactgatttcgccgtgctttgatgacggaaataacagtggccgccggccaatacatgttcaccatgttaaaggctatgctgacggctctacctcccgtagaatggggtgccatatagcctgatgatagcgtaactaccatcaccgagacgacgtaaataaagccgttaagccggtggattttgcggcttttggccaacaagccgctggagaagttgacagctcccgaaaccatcgccaaacaagcggcaatgacatgaacatacatcacctttagccagatcgggaggtgaaaggagtctcgcaggtgagatttatggctcagaaaggacgttgattgcggatcaagaattaaattttcaaacaatgtatacagaacatacaccgcgattaggatcagcattgccgaaaaaaccgattgactgcgtttaaatttatttttgttcagcttttgtccctcctaaaacatcatgctctctcaggtgcttatattgtatcacgaaagcggacgagcgcagcagcttggcgttttaggacctctcaataacaaaaccattaaaaacaagccgtgtactgtttcttccctttgttcggatctgagttttcctgggaaaccggtataactctgtcatcttttgcggcatacttttgaatgatgtctctgcttgaagtgttatcgacgataacagatgaattctatcccacaagccgatatgatcaattacttcaaattttaatgttataatagactttaaaacatgcgggagatcaggcttaaaaacaaaaaatggaggcatacataaagtgacagaagatgtaactgacaacgatatacacgaacaaaaattatcgagaggcctgaaaaacaggcatattcagctcatcgccatcggcggggcgatcggaacggggctgtttcttggttcggggaaatcaatccattttgcaggaccgtcgattttatttgcttatctgattacgggaatcatttgttttttcattatgcgttctcttggagaactgctcttatccaatttggaataccattcgtttgtcgactttgtaagagactacttaggcgacatggcggcatttataacggggtggacatactggttttgctggatttcgctcgcaatggccgatttaaccgcggtcgggctttatacccaatactggctgcctgatgtaccgcaatggctgcccggattgatcgccctgatcattttgctgatcatgaacctggccaccgtcaagctttttggagaattggagttctggttcgcgttaatcaaagtcattgcgatattggcgctgaccgcgatcggacttttcatgatcttcaaaggattttccacccattcgggcactgccgcctttcacaacctttggagccacggcggcatgtttcctaatggactgcacggatttctcctttcattccagatggttgtctttgcgtttgtaggcatcgaacttgtggggctgacagcgggggaaacgaaagatcccgaaaaggtcattcctaaagcgatcaacaatatccccgttcgggttttgcttttttatatcggtgcgctccttgtaatcatgagcatctatccgtggaatgtcatcaatcctaatgagagtccgttcgtccaagtcttcgcagcggtcggcatcattgcggctgcaagcatcatcaactttgtggtgctgacatcggcggcttcggcaagcaacagcgcagtcttcagcacaagccggatgatatactcgctcgcgaaagaacataatgcgcccggcgctatgaccaaactgacctcccgcaaagtgccgggcaatgcattgtttttctcagcggtcgttattctgattggcatcatgctgaactatatcatgcctgagcaagtgtttacgctcattacaagcatctcgacgatatgcttcatctttatttggggaataaccgtcatctgccatttgaaataccgcagaactagaccggatttagcgaaaagaaacaaattcaagatgccgctttacccgttttcaaattatgtggttctcggttttcttgcgtttatcctcattgtgctcgcactggcgcaggacacccgtgtttccttatttgtcacgccggtttggtttatcatgctgatcgcgatttacaagctgagaaaacctaagtcacggcaagtgtagaaaaaatgcgaatcgcctgcagaaagttctgcgggctttttgtatggctcttgctgtaaaattaaaaagacaacagccgcacatcaattcaatggtcagccgcttaggcagaaaggggaaaacagatgaaaatcaatcaaattgtagatttgtcggtatcgctaagaggcgatattccgtctgacccgccggggtttatccctgaaatcgaatatgcggatcataagcaaggagccaaacagatggtccagagctttcccggcctctcttcgcaagatcttcccgggggagaaggctggtcgctggaaaaagtgaaaatgtcaacgcatgccggaacgcatatagacgctccataccattaccgttctgttactgatgacggcaagcggatgatgacgattgacgaagttccgcttgactggtttcatggccccggtgttaagctggatttcagacatctgaaagacgggcatatcgtaacccctgaagaaatcgaacaagaacttcaccgcatcaatcataaactcgcgcccggggatattgttcttgtgaatacgtcggccggtgccaaatacgggcaaagcgattacctggacagcggctgcgggatggggcgcgaagcaacgctttttttaacggaacggggcgtgcgccttgtcggaactgacgcttggagctgggacgctccattcagcatgaccgtcaagcgctttgaacaggaaaaagacccgtcgattatttgggaaggtcattattcaggaagcaccattccttactgccaaattgaaaagctcgccaacctggatcaattgccttccaccggattttatgtcatggcttttcccgtaaaagttgaaaaagcgtcggccggctgggcgcgtccggttgcaattcttagcggtgaatgaagcctagggatcatcgcgggggctcccttggcataaaaaagtatcgtatttaaacagcaatgcttttttatgcctcctctacgggggaagctactctataaagatacccgcttttctttatctttgttataagttctgttaaataaataagttgttgttaaaagagcagcaattacaatgatgaataaaacgaagtatccgtaaacagtttgacccgccggcactactgtaatcgtcaagatgcctattaaagcaacttgtcccaacagctttaccgcattaaacaacgaattgacacgtcccatatatgcattatcgacatgatggaacatatagctttttctaaatactctgatcgcagcatttgaatgcccccaaaagaggcttgccactataaatgtcacggcattcggaacgaggaagatcgcaattgttgctagagcaaatactgccataaacaatataacaccttgcatatcagaccatttctttgatatttgatatgcgacaaagcccgcacccatagctccaatggcgtaaacaatattggcaatgccgataactgacggaccttcgtttaaatagtcgtaaatgaaaaccggatccaagtagtttgcgacaataatcacgatgcttggtataaaagaagtcaataaaagaacaaacaaaacttttcgataacataaatattggagtgaggatctgaagtttttccagtaagattcatttttcattgtattggaatgctcttccgcttcagcatttctttgataaggaagttggtagatgaggatggaagctgctataaatgtagagatgttcataaccaaaataactgccgcatccatcttgccgatcatcatggcagccagccccgaactaatcatcagcgccgcctgcccctgaacttcaagactgctgttcactttactatagtcctcttttttgaacatttcctgagttaaagcggctaaagcaggatactttatcgaatcgtaagctgtatgataaaaaatcagcatcacaacaagggtgatgtccaactcggcggaaacattgtatagaacagaaaaaacgcccaagaccactattcctgtaatttccagatagaggaatgtcgcttttcgagaatatcgatccaccaaactccctaaatagggtgaggcaaaaaacactaaaatcatcgttgccatcgtcaataacccatataaaacggattgtttcaattgatcaatcagcagccagacaatcaaataggaagtgatgccggtacctacggtggaaatcaaattagcggcaagcaacagtttcaactttcgcaattacaaatcacccattttggtttccaaatgcacacgatggaattagataaaagacaaatagattttggggtacagaatggaaaaggctgttttctttcatttcatcacgctccgtatttaaaactcatgattataaatgtgacatccacctgctttttatttttttctttataatatcaatcacaacacttgcgtaaacaaacaatagaatgaatacaataaacacgcaatcccagccatcatgttgaaggttcccgatttttcattgtttgatttcaacatcatgaagaacaaacccggaaaagaaaaatccgataaaccagccgattggaatttggacaaaagctaaaataaaaccaataatccctgtcgtttgaaaaactttaggtgcaaattcgcgcaaaagtattcccgccctttttttgtatcatagcacatctaatctgcaaaataaggaattcaagtgaatctttcactattcattttatcctattaatcgaggttcacgaaacgaatgcaataccagatccgcaaaagcatccacagcaggcagctgccactttttctttttgataagcatctgggaataaagcgggtcgaggtattgagaatgaggaaggattttcagtttaccgctttccacttcgtctttcaccgtaatgtaaggcaaaacagaaaatccgagtccgctcatgaccgtttgttttattgcttcgatgctccacaactccatcgttggaaagtaatgaatatcgtttttcaagagatatttttcaaacatggttcgatagctgcagtcttcttcattcgttataaaaaaatgtttttgatattcttctaaatcctcaggcccttcactgctgccgacaaggacgatcttctcctcagccaacgtgtagcgaatgcatttgtccagctcgatttcgggataaaccattaaagcgacatccacattcccgcttaataagtcgacttggttttgtccgcatgtaccgttgctcagtttcaatttgacatgaggatatttcaacgaatactcccttattattggccccagcctagaaatggttaaagactcgggcgcagccactttcaatacccccttcacttcgtgagcgctctgcaaattcttgatctgattatgggttgacagcaattcttcggctaaaggcattaactcccttcctaactgagtcagttttaaattccttttttcatacgtaaataaagccccgccgatctcatgctcaagagcctggatatgagtggtgatcgtggattgagtatagcctaatttcgaagccgcccccgtataacttcccatttcaacgatggtctgaaacgtgattaaatgtctgatttccattcgatgtctccttaacacttgatctatcgaaaaaatcaataatgcattttgatatttcaattttatttatagttatcattatcatacaataaaaactgcccactatgacattagcaaatgaaggtgattaaatgagtattatagcttttctttcgtatgtgattatgacatccattacgcccggcccgagcaatattttaatgatgaatgaagcgcaaaggttcggctttacaggttcatggcgttttagcagcggtatcttggcggggtttgcagtacttgggattctcagcggtgcctttacaatcagcctgtacaattggattcccgttgtagagccttattttaaacttgccggcgcgtgttatttgatttatttggctttgcaagtcggctttaccaaaaataaaaaacaggattccacagaagcccgctcctcttttatatccggctttatatttcagctgatcaatattaaaagcattttgttcttcttaaccgtaatgagcgcgttcgttttgccgttcaaccattccttgaaatcgacaatctattatttggcattagccattgttctcgggtggctggcgctgctattatggtcgggattcggctccgtttttaaaagggtatttgcaaagcacgaccgggtatttcgagtccttatgtgcctgctgctcatgtattctgcggtgtctattttccgatgactgatcatcaatttattggaaatcgcttcgaaggacaaaaaaaacataccaacaagacgtggtatgttttttcttaggaaggccctcaaaaatttttgctaatgaatattaggttttctaaaattactgcccttaacttcagctacgtcatatacagtaacaaaagcatttttatcaacttcattaatgatttcttttaatttggtgtcttctaagcggttgatgacacaggtgatttctttaaatttctcgtgggaaaaacccccgtaagcttctttatatgtagcacttcggcccaattgatcacgaattgtctcaaccattaattcaggttcgcttgtaatgatttgaaaagttttagatccgcttaacccttcctcgacaacatgaatgactttggacgcgatgtagtaggcaatgactgacagcaatgccccctgcaagccaaatacagcggaaacaaaaataaacacaaaaaggttaaagaatagaataagatcgctcgttccaaatggcaattttcgcgataacaaaacagcaagcatatcaattccgtccaatgctccgccattgcggagcgccagccccattccaaatccaaggatgatccccccgacaacagtgactagcaaggtatccccttcgattatagctggagtgtggtgcataaaacttgtccctgctgcaagtgatgcgattccgataatggacaatagcgcaaagcttttcccgatttgcttatatcccagccagacaaacggtatgtttaaaaccgcgataagaatcccaagcggcaaatcaaacagttgtgaaccaacaatgctaagtcctgtcactccgccatcagatacactgtttggaatcagcactgtttccaatccatatgccgctatgattcctccgatcatgaccattatgactttgaaaatcatcttcgctctaaatttcctatgtttttcgattttattcatgccattcctcatttcaatttttacgttatatttaaatataccataataaatttattctgttaaaaagttcaatcacgtatcatggtaagcaggctgccgcgaataccgctctttacttgaattaaggtaacccttttagacttggaacattcatgtgccgacaaagctatattgcaagcacccagttttagcaacactaaaggcccactcttaagaagcaaccgacacatcgttctgcagttaatctatattgacatttccagacaaacaaaaggattgttggcaatagaacgaagctttttgattcttccctctccagtaagaatgaaaccttaactttattggttttttaaaccccattcacataacccttctaaaaccggcaatagggattccgctttatccgtgagactgtactcgaccttagggggaacttgagggtactctttccgtttcaccagtccatccgcttccaattctttaagttgtgaactcaatgttttataagtaatagcccctatttgtcttttcaactcattgaagcgaattggttgattttctgccaggaggtaaataataaccattttccatttaccgccgataacagacaatgtgtatccaaaaggtgtatcttgaatatttttcactttacctttatattctgccatactcatttttacactctccttttggatagtacctgtcattaaagtgcgtactatttttttatttgcgttcattttatactaaccttactttgaagtaaaggagactaaaacatggctaaaaaaacaattcgtctgttaatgccgcaatggcaagggggaaacaatcccaactactcttttggagcagaactgcttgcttggctggctcctgaaaatgatcagccccttattcatgttccggttcaaccttatgatggaactccgcttgaaaacgaaaacgggataaacgggagaaaacaactgctggaacaattggaggctgctcagcatatcattcatgctcataagccggatcgcattgtcatgtttggcggtgactgcttagtcgaacaagcaccatttgcttatttaaacgaacgatacggcggggacttaggtttaatttggattgacgctcatagcgatttagttagatatgccggttatgacaacggtcatacattaccgctcgggaatcttttgggagaaggagatgaagagttcgcaaaacatgtgaaaattcccctgaaacctgaaaatgtctttattgcgggattagcagctcctacagaagaagaaacaaaagtgatatcaaatgaacttcaaagacaaggtatagctcccacagaaccagacactgaagtgattcaaagacttgggattagaactgccggaactaaaaagttaatgaccagtaccgaacctataaaagaatggataaaagaaagcaacatcaagtatctggcaatacaccttgatttagacgtgcttgatccgaaggcgtttcgttctttattattcgccaatcctgaagcacctgtaaatttttctcctgagggaacaatgcaaatgccgtacctgcttcatcttctgaaagaactctcttccgaaacggatgtggttggattaggtataaccgagcatttgccgtgggattctattcatttgaagaaattgcttagtgaaatccctattttaacccaataattttttaaacgggatgacaacaaaataatagagtcgaaactctccataataatagagatagctttccatcgccttgtcatgttacatgatttttgcccttcacatgttgctcactagaatcaagtggaagaaagaaataccaagggcttatcaacccttggtattcctatgatgcggtcgagacaacttgaacttccgcggggttgtccccctccccattaggtcctcgacaaagtttattcgcccttttcacaataaacaactctacacgacataaaaaaagcaaatcattcggcctgccttttcatttctcgctctttatgatgctgcaaatatgactgctctgattccgacctttaattcctatacgaaagggttgaaggtagatttatatctaattttccagcctctttttcatcgctgctgccaattgctccgaatctggatctccttcattttgcaattgatcaatgatgttcatgtagtctgtatcatttcggttctgacttaatttatatgcagcctgaatgtcttccaccttaatcttaaacccgacaatcgctttcagttgtctctccaaaagttgaggagaaaggttatcccataaaattggattttcccgatgcttctcgtatttttccatcatgattgttaattcttctattaattcatctctctctagaatgcttgctttaccgtatatatggacggcttgataattccatgttggaacatcctcatgcccataccaggaagaagaaatatatgcgtgcggcccctgaaacatgacaagcacatctttacaggtttccaaagttcccacctgcgggtttccataagcgatatggccagtgatatagtaatcatcgccttttttattgagccctaaaggcaaatgagtcgcgattggcttcccttgttctgtcgtaacaatcgtgccaaaagagtttttttggacaaaatccaaaatttcatcagcattttcgactttaaaatattttggaatatacatcgtcatcctccttttaaaaagttataggattgttttggccatgataaagtccgtttgctcttcatctcccatataaaaagagtgggcgccggtttgtacaaaccccattttcttataaaaagcaatcgcattttcgtttttttcccatacgcccagccagattttctttttattcagttcctttgcaatttccacagctttattgaacagatatttgcccaggccgtgtttttgaaagttgttcttgatataaattctctcgatttcaagtgattcatcacccattttttcagactgggcctcatcggtgttgacctttaaatatccagcgatttcgttgttaaaataaacaaaaaagaattgcgaagagctattggataattctttttctaattgttttaagttaaatgccttgtccaagtaggctttcatattttctggcgaattctgatgcttaaatgtctcattaaatgtttcataaccaatttcctgaagcttgtgtaagtcttcaagggtacacctttttatatttactgtcatttcaatctgccgctcctttacgtgtcaataatttctcttgttcccctttttcacgaattcccagtccttttctacattttttcttactctttgaagaagattgaagatgatctccgcttccccctcggaaaatccctctaatgccacacgattcgaatggtcattttctctttttataaaaggaaatacctcatttcccttttccgtcggaaaaagtttttttatttttttgttatgttcatcatctctccgttcaataaagcccttcatttcgagtttttttattgcacgggctgcggtggtcctgtctactttaatcatctcagccagcttctcctgaatgattcccgggttttcgcatattcggacaaggtacaaatattgcccttttgtcaggtcatgttctttaaattcgatattgcttatagaatccaatgctcgggcaatcattccaatttcacgcagaatatccttcatcataaacccctttcgagctttttgttgcaaatgcaatataattagcgtacattaaatataccggaatattgttgcatttgcaataaaaaaacaaaagaggtcgagtcaaagtgaaatatcttttttatgtaataggaattttaatcttaacccttggtattgctttcacgattcaatcagatctcggcgcttcgccttttgacgcacttttggtgggactggccgtacatgcggggcttactgtgggaagttgggaagtcatcattgctctgctattaataggctgcaattcggttttaaaaagacaaagaccggaagtttcggggctgctaacagcgtttataaccggtatcggcattgacatgtggctttttttgctgcatttttttgtgacaccagaacaatggtacagcaaagcggtttgttttgggatcggcttggttgttacaggattaggaaccgcgacatacttatacacaaattttgcttcgatgccaattgaccgtctaacattcatcataaaagaattaacaggaaccaatatatttttttcgagaaccatcatttaccttgtcttcttgacagcggccgtcatgttaaaaggaccgattggcatcggaactttattaaccgtttgtttaggagggctggcccttcatttgtttatgccgtttgctggaaaagtgttgggtcgctttacagacgctcgtacatgacgataaggaatgtttttaatgccgctccctactttttcacagaacctttattgaaaatcatcaatatgattccggatgctataagcttataactaatgtagaggtatctaacctaaatatattttttatcccattaaagaaaaatgaccataaaatatatatcgtgatagcacttagcgtaaacattctgaaccatctggggattgcgagccaagcctttaaaagtttagttgagaatttccctattttgttcctccttattcataccccccttcaatatattaaaagaaagacaatattgacataatctcaaataagtgcaactttatttatagaagtattaacctaaggagccaataacaaatcatgaataatgtttcattaatatataaggaattcggtgatccgcttcaaaaattacagctacatgccggagaaaagcttcctcttcagccaaatgaaattcttgtcaaaatgattgccagtccaattaatccatcagatttgcttccaattagaggagcctattctcatagaattaagctgccggctgttgcaggatatgatggtgtggggattgtcatagatcagggcaaagatgtatcaccatcattgattggaaaaagggtcctccctgtaagaggagagggaacttggcaacaatatgtaaccacaaaagctgattatgctatagaacttcctccatcaataagtgataacgacgccagtcaactgtatattaatccattaacagcctggctaatttgtacggaatcattgcgtgttcagccgaatgaaattgttttaatgaatggcggaggtacatctattgcaggtttgtttgcgcaaatttccaaaatactgggattccgtttaattgtcatgacaagaaacagccgcaagatagaaaaacttcaaaaactcggggcatggagagtcatcgacgcttccaaaggttctatatatgaaaagatttctgatggttgcgacatcggtgttgaccatgcaattgactctgtgggaggagaaagcggcgaactgctggcgagggcattaaaacctgaagggacgtttgtcagttatggtctattgtcaggtataccaaacgattggcgaaagctacacgatgtataccatgtgtcaccgcaattattcgccttaagactttggaatgagagacattctgtttctgaatatcgcaatcgcttctcggaggtgattaagcttgttgagagcggaagaatggtcatcaatgccccagaaaaaatatatgattttgaagatttttatgatgccttgaagcattatgaacagccgggtttgaatggaaaaatacttttgaactttgcatgaaggagatgtaaccaaaaagaaagaatgagaagtagttgtattcgaaaagaaaaataaataatttatatacattccgcatattgtcaatccagtatgttatactgtaaacaaccttttaagcttgaaatcttctttttattgctttgcaccatctccctactcgaacgttgagtaggtttttttattaagcattatacagagaacataaaaaaacaggctctacatagagagcctgtttgtataaacgattgaaaattaagcagttttttgaacgttagcagcttgagctccgcgaggaccttgctcaacgtcaaatgttactttttgaccttcgtctaatgatttgaatccgtcgctttggattgcagaaaagtgtacgaatacatcgtctccattttcacgttcgataaatccaaaacctttttctgcattaaaccatttaactgtaccttgttccatttttgttgcctcctagtgcgttaccgcacattgtattactatccttgcccaaagtatcatcaagacgaaaagtcaatattcatactatcctttacaccgaacaaaaataattcttctttatcataacaggaaacggaaataattgcaattcctattattgttttattcatggcattatttcttaaacgcgtggatatcagtgcagaagcgataggcgtcaatcattccgcataaaatttacaacatgtcttagagggctaagaactatggtttgaaaacaccgtgaaaatgaatcacgagtgtcttcaaacctttttctttgctaaaattgattttctttaaaaagctctgctgtttcttgttcatcatgtttgttagttaaacaatcaatgttcacggtctaaaaaaaaacaattcccatagggaagcagggagagagtttggcccgataaagagccgggtataattttcataaaattgagctggaaatcagtttcgagtttccaataaagagggctaagaacgatacttatatgatgtatgacgcttgggctaacgtaaacttagaaactcatcagggaaggggaaacttttaaaaatgaatgaccaaaatctaaagactttgagaaaactagttacaccttatgaaaagtccgatttacaaaaaagcatttaccaaatcattaacacattgataccatttttcctgttatggtgtttagcatataagagcttgtcgatttcttatttccttacattagcgatttctatcgttgcggcaggttttttagtgagaaccttcatcatctttcatgattgctgccactattccttttttaagaacaaaaaggcgaatcgaatccttggaacaatcacaggaattctaactttgcatccttttgatcattggggacgcgaccattctatccaccatgcgacaagcagcaacctggacaaacgaggtacaggcgatatttggttgctgaccgttgaagaatataaggaagcctcaactaagacaaaaataatgtaccgtttatacagaaatccgtttgttatgtttatgattgggccgatttacgtcttcgggattaccaatcgttttaatcgtaaaggggcaaaacgcaaagaacggatgaatacgtatgtaacgaacttgggaatcgccgctttgacagcacttttatgctgggctattggctggcaaaacttcctgctggttcaggcgccaatttttgatatcgggatctctcggaatttggatgttttatattcagcatacgtttgaggattcttattttgaagaagatgagcattgggaatatgtaaaagcagcagttgaaggaagctctttttataagcttccaaaagtcatgcaatggctaacaggcaatatcggtttccatcatgttcatcatttaagcccgagagtcccaaactataagcttgaagaagtgcataacaacattgaaccattgcaaaacgttccaaccattacactggcaacaagtcttaagtcgttaaagttccgactatgggatgaagaaagcaaaaaatttgttggttttagccacttaaaaaaagcttctaaaagccaagtatcagcgcaactaagaacggattaaataaacttcccataatcgatgataataggcagtgtatcttgagaataaaagtgcagactcgcacaacggttttgtgcagaggtcagcacttttttagtgccaaatatacttgcagacttggacaatgctgtacattttttgccgattttccgcaaaaaaataataccaaaggcaattaaaactttggtattatttggtgttaaaccgagagacctgaacctcccacgggggtggccctcaataaagtgaaagcttatcatggtttatgaaagcttattttcattgcatctatttaatcgattacacaaaatttgattgttttttattaattatggagtaagcttttcagtaaagcttatcaaagttgattttctagtgaatattatcacccgaccgcaccattcttaccggtctttgccccaccgaaaaccataaaatgccccattaaaaaccatgaattacaccagagcaaaatgtgaacctgacggaacaagaatttcgtcaggttctttctgcaatttggctcttgttatatcaaagtaacctaaacaaaaataaaattattttatccttttgtataagtttactttacttttgtaaaaagtaagtttataatttgattcaagaggtgatggtcgtgaagaaagactttggtgattcgatatcaaataaggtttatgaatatcgtgtacttgccagaatgtctcagcaagaattagcggagaaagtcggggtttccaaacaaaccattttcgtaatggaaaaaggaaattatgttccgactctgctgttggcttttcgaattgctgaattttttaatgttgatgtaaacgaaatttttacttatgtgaaaggaaatgatcaaaatgataagtaagtttttctcaggtatccataacacaattttttcccctttaaggtcctgggctgaacaatctccgggaaattggaatattctcatcgttgttggttttttattggtttatggtagcgggattttggtctatgtattttataaaaagcttggaaaagacgacgaacggacaaataaaatctatttgaaaagtagttcctatatgctgttggtcattattctatgtgacatgatttttcctaaagatgatatgtggaccatctttttcttgtacaaatatgcgctggcatttttagctgctgggatttacctatccgtccaatataaaaaggatttttcataagaaaggccggggagtgattctcagccatgggcggaggattagacaatacctccttacagactgatgataatcaccccccttaagccagagattgctgaattcctattttaagaagccaccaacctcgtattgaatgatgattggcggcttttttataagcggtggtgcaacttatgatattcagtggtggattacacgatattggatggcgcaaaagatggttagcgtggcgcaatcggtcgataatattcacttggtcaaaaacaacttcctcacgggcgtacttttcaattacagccctaaatcgttcgatttccggtgcaatctaattcgtgggaagtagacataaaaaaacaccaagggcgtcaaaacccttggtatctctggtatgcggccgagaggacttgaacctccacggggttgcccccactaggccctcaacctagcgcgtctgccattccgccacgaccgcatgatatgttgttttttaagtgcgggtgaagggactcgaacccccacgccgtaaagacactagatcctaagtctagcgcgtctgccaattccgccacacccgcgtgaaaaaacaatggtgagccatgaaggactcgaaccttcgaccctctgattaaaagtcagatgctctaccaactgagctaatggctcaaatataatggctgggctagctggattcgaaccaacgcatgacggagtcaaagtccgttgccttaccgcttggctatagcccaacatatgagaaatgacccgtacgggattcgaacccgtgttaccgccgtgaaagggcggtgtcttaaccacttgaccaacgggccatatgaagtcagcatcatattttcctaatggcggagaaggagggatttgaaccctcgcgccgcttacgcgacctacacccttagcaggggcgcctcttcagccacttgagtacttctccattggctccacaggcaggattcgaacctgcgaccgatcggttaacagccgatagctctaccactgagctactgtggaatgatcagactcattttattataaatatgtcgacaaaatgtgtcaagaagaacaatttgtctttgtggctcgtcttgcgacggcttttataatttatcatagacaagcctgatcagtcaacccttttttatgatttcttttattttccctccgcacttgccgcaaacgtaacggcttgtatccattttccgctttcggagaaacgtttgtccgcatgcttcacacttgtatgtgcgtacttttctttgcggctttttctctttttcgagcggcgtgcagaaccgcggcgcaccgacttcctttaatagcgttctaaaatccttgtcgcggtgcttgtagccttttccttcaagatggaggtggtaatggcacaattcatgcttgatgatgccttcaagctctttttgcccgtgttctgtcaggtattttttattcagctcgatattgtgggaattcagcaaatacctgcctcctgtcgttttcaggcggctgttgaagtaagcgcggtgccggaacggttttttaaagtatgtgagcgaaagctgttctgtcagctgctgcagttgttgttcatccattgcttgggtccacctcatttttaaaaacattgaacaggacaaattccgggcggcataaactaatacacgacacccatactcttatgataagagcctgaggagggatgagcaatgccgaattggctcaaaaaccagatgcagagagctttttatgaaaaagatcattaccagattaaattgctgaatcagtgctggtatttttacagaaaaaaacactgctgatgagcagtgttcatccgagtccgaatggaattttcttctgtttcctcatcatcttcaccggtccttttatcatctcacacaatggcgcccgttactccccaaatggagctgaccgcccgatttcggggagcatgggcgaatggttcttctgcggatggacgagccgtttattcttttcttttaaacggaaaccagttggctgagccgaagatccgaaccattacagggacgaacagcggcagcatgacgaatgcatacagcaaaagacccgtcagcacaagggtggcgatttgcagaagcgataaaacgccggacggcagcatcgccgcgaaggttcccgccaagatgacagcggctgaaataataaccgatcccatatttttcatcgattccgtcatcgccgtcataatatccgttccccggtattcgttaaaccgttccatcaggaagatcgaatagtccacaccaagcgcaattaaaatcacaaagccaaagaaaggcaccgcccagttgaggccgggatagccgaaaaacgccgtgaaaataaattcggttacaccgatggatgcaaagtacgtcaagaccagcgatccgaccaaatacaccggcatgacgattgaacggaacagcaggacgaggatcaggaagattccgatcatcatatagatcaccgtgttgctgaagtcctggtctgacagctgcttcaaatcggcgttgatgctggaaacgccgccgacgccaaacgatgcatcgtgcaaatgcgtgtcgggaagagcccgttttactgatgcttcaatgtctttgaccttggcaatcgctccgtttccatacggattgtcttccaatatcacatcgatcgtcgtgatatggcggtcgtctgacatataggaattaaacacctgctgaaattgcttgtttttcagcacttctttagggacaaaccagccggacatttcttgatccgatgcgtttttcagctgatccaggtagtcgcctgctcccatcagaccgcttgaaattttttcgaggccgtccacgcttgaattcagcccttttgttaattgatcgagctggccggcgaattctccgactttttccttcatctgcttttggccttcagcgacctcacctgcgcctgattcgagcttaggcagcgaatcggcgagctgtccctgccccttcgatgtctcttcaagccctttttcgatttggccgaggccgtttatcagagcatcgattttgcttgtgtacactttttgctcttcctgcgcttttgcgataaatgcatctgctgcttcaagctgctttttcgcgtttgccgcctgcttcgtgtaaacggccgctttctgtgatccctgcttgattgccgatgcaagctctgtgtaagagcctttgatcgccaaataagaaggattctccttcacttcgggaatttcgctttcaagatttttgaaattttgatttgtctgctcaatcatcttttgcacgtcagccgttatgccttgggcattttcggcttgagacaatgccgcttttaagattttcgatatttctttgtaggtttcgatttgtccatttaattgatcgacttgcgccgtcagctgttttttcgcagtttggatttcttttttcgcctgggcgacgccttgtttgctttggtctgttccttccttcagctttctcatgttggcttcaacgtcgctgattccggcttggatcgattcggttcctttgatcagctggttgattccttttccggacgcttcgatttgcggattttgatccgcgattgacttgctcgcttctgcaagcccgtctttaatctttttcagacctttattgccgctttcaaggcctttattcagctcgttcgcctgtgttttgacgtacaggtcgctcagcccttttccgaccggccgggtcgcactgcgaactttgctgacgccgtttgtctgttcaatggcgcggctgattttttcaatcgcgatcagcccgtcattggtatcgagcgcatccgatgttttgagcacgaccgtgaccggcaaagattctcccggcccgaacttgtcggaaatggtgttaaatgcgctgacggattcgtattgatctccgatttcgtcaaggctgttgtaggaaagcgttcctttatacatcaagatcggcggcacggccacggccgctacgatcaacaggctgatcagcggcttactgaaagcgaaacggccggcggtttcccatagctttgactgcgggtgcccgatatttcctctgacaggccaaaacagcactttccccaaaacagccatgaaaaacggcacgatcgacagaagcgccaaaatcaagaccgcgacacccaccgctactgcgaccgcagacttgtaaagctggaattcggcaaagccgatgcaagtaaaaccgatcaaaacggcgattccgctgaacagaacggttctccccgccgttttatacgttgtcagaatggcttcgatcttgtctttcccgcgggcgatctcttccttaaaacggcttaaaagaagaatgcagtaatccgtgccgattccgaacatgatcgccaccataaagatttgcgtaaacgtggacagcggaaaatcagcgtatttgactagataggcgacgacggactggctcacaaggtatgaaagcgcgaccgccaaaagcggaacaaaaggcgcaaccgcagaacggaatacgagaatcagcacgattaaaataaaaccgaccgtgatatattcggtcttcttcaagccttcctgcgagcttgtcatgacatcatcatcgatgagcggctgcccggtcatctcgtagtcaagttttaaagttttaagcttttcattgacctttgctttaaattcggccgcactgattttgtttgcatcaaatgtgacaggcacgagcagcgtcgttcgatcctttgacaacagctgcttttgaatatcctcatccgcgttaaagtacgatgtaatatctgagacgtgaagggaggaatccttctctaaagtggtgatcgctttttttaaagccgcctcccgattcggcaggaggtgtttgtcctgaaatacgacgacaaccgatttgttcgtatccccgtcttttgacatttgttcgagaagcttgttcgcataagaagacggatagccttcaggaaccgctatctggcccttctcctttgttaattgccccatatcgggcgccgtgatgaataagacggcggccattgcaatccagagcgccgcaatgatccatctcgcctttataatcgttctcattgatgttttattcctcctctatgaactttgcaggtagattgatttctttgtattttaagaaagtcggcagaaaaagccgcctgctagccttgtccttgctgtttttcattacttcaccactttattcgcaaaagtgaaagatcattcattttacaggaaaacagctgaaaccgcttgattaacttatcggctgataggccattgatatttgaaggttttaaaaaataaacacctattgattaataaacacatgttcattataatttggggcaaatggggtgttcaatcggcaattggggttgagatgttcaataatgaacaacatacgtaaatttgtttataaacggaggtcaccgatggaggacagaaggtcaattaaaacaaaaagagcgataaaagaggcttttttaaagctgctccatgagaaagaaatcaataaaattaccgtttccgatttatcgaggcgcgctgatttagggcgcgggactttttatcttcattatcgggatgtttttgatttgtatgaacaaatcgagaatgagttgtttgatcagctggggaaattttacgatgattattttccaagcgaagatccgcaccatctgctcaccttcatcgaaaaaacgactgaatatatttatcaaaacgctgcaatcttcactttattgacgaaaccgaaaggaaacattttgaccatcaataaatttaaagattttttcaagcagaagattttcgaagaattgagcatgatgcagcaatcaggtaatgagatggcatgcgatgaaatggaaattacatttctagtatccggagcggtcggcatttttgaagagtggatcaacggcggcatggttcagacgccggcacatattgcaggcgtcgtccaccgcatcctgttgaaaatcgcgatgtaaaagataagcccgccggaaaataaagcttccggcgggctgacttcaagtcctatcgatcttttaccatcgataaggagacccttccttttgcagcgtcgacatcttccacccatacggtgacgatgtccccgaccgacacaacgtcgagcggatgcttgacgaaggaatggctgagcttggaaatgtggacgagcccgtcctgtttcacgccgatgtcgacaaacgccccgaagtcaacgacgttccgcactgtcccctgaagttccatcccctcttttaagtcctccaattgaagcacatcggtttttaagagcggtttagggacttcatccctcggatcgcgctcaggcctcgtcagctgggcgcaaatgtctttcagggtgatttccccgatccccagctgttcagctgcttcggaaatattcagttcgttgattttgtcctgaagctcttttgtgccgatttgggctgttgaaaggcccagctttttcaggagctctctcgtctctttatagctctccgggtggatgcctgtccggtcgagcggttcatcgccgtcaggcacccttaaaaagccgatgcattgctcatacgttttcgcgcccaggcgcggaatgtctttcagctctttccggctcgtgaattttccgatctcatcccgttttttgacgatgttggccgcgactgttttcgatagtccggccacatattgcaagagcgcggctgatgcagtattcacgttgacgccgacctggttgacgacggtttccacgacaaagcggagcgaatcgtttagttttttctggctgacatcgtgctggtactggccgaccccgaccgacttgggatcgattttgacgagttcggcgagcgggtcttggagtctgcgtgcgatcgacacggcgctccgttcttcaacctgcagatcggggaattcttccctcgcaagctctgatgccgaatagacgctggctcccgcttcattgacgatcagatagtacacctttctgtcgatgtccttcaagagatcggcgataaactgttccgtctctcttgatgccgttccgttcccgattgcgatgacctcgatttgaaagtcttcgatgatgcgttttactttttcgatggcggcgcttttcttattgacgggagggtgcgggtatatgacgtcgatcttgagcatctttcccgtctcatccacgactgccagcttgcagcctgtgcggaatgccgggtcgacgccgagaacgagctttcctttcatcggcggctgcagcagcagcttgcgcagattttcggcaaatatgtgaatcgcttggtcttccgccttttccgtcaattcttttctgatttccctctcgattgacggctgaatcaggcgcttatagccgtcttcgatcgcgcttttcaggacatcttgagcacttgtttgcttttgttgtaaaatccgtttttccaagtaagcttggatgcggtctgccggcggctcgaccgacgctctcaaaatctcctctttttcgccgcggttaactgcgagtacgcgatgaggaacgattttttgaatcggctcttcgtattcataatacatttcatagattttcttctcatccgcttcggcatcttttgccgcggacttcagcgttcctcttttaaaagtctcctgcctgatccacttcctgtattccggttcgtctgagatccgttcagccagtatgttctttgctccttcaagcgcttcttcggcgctcatgacttccttttcttcatttatgtacttgcgggcttcggctgctacatcttcattacgcgggagcgagatgatgaaatcagccaaaggttcaagccctttgcttttggcgatcgtcgccttcgtttttcgtttttgtttaaacggtctgtataagtcttcaacttcctggagcttgtctgctttttctatatccagcttcagctgtccggtcagcttgccctgttcatcgatcagcctgatgacttcgtctttccgctgatttaaatgctgaatgtatccccagcgttcggagatagtttgtatttggacttcatccatggagcccgtttgttcttttcggtatctcgcaataaaggggacggtgttgccgtcctctaataattgaatgacactctcgacatgctttggcgcaagccccgtttcttttgcgatttgtttgacgattgacgctaaagtatccattgtagcctccaaaagaatgttgtcttcttagtgtaccaaaagaaacggaaaaacacctatatcaaagggcagcttccttaaaaaagctgtccaatgatataggtgagatcgtcttttcccattcgtgtgtatgattcaagctgattcgatatatctcccggtgtatggtgctgttttaaataagtccggagggcgggtacttccaaaccgtctgaataaatgatgaatcttgatcctttttcatacgtataggtgaatgttttgtatgtttgcggttttcccgacatgtatcccgtcacagggagagggtggatatatttgtccgaaggagcgtataagataaagcgaatattgcctacagagctgtaagcgatcgtccttgttcgaaaatcgacttttaaaattgaaacggtcgcaccgcgcttatgtttcagcgcttgattgcaccgttccatcaagctttcgacatcttcatggccgtgctcttcgacaacttcgctgatgaccgaagaggattcgcgtgccaacgcaccgctgccaagcccgtcagccagtgcgcacaccatggtttcgtcagtcgcatggaaataaaaactgtcaccgcagacggcttttccttctttaggaagctgataaacaagcgcttgcatgtgttcattcgactcagtccaaatcatggtttaagctccatatacggatcttcagccaatgcttccctcagccttttgacagctttgcgctgcagccgtgagacgtgcatttgcgatatgcccagcatttcgccggtttctttttggcttttgttttgaatgtaagtcagctcaatgatttgcttttcacggtcggatagtacgtgtaatacgctttcaagcatcagcttttggttcaccttttcatagccttcctcctgcgagccgacgatgtccaagatcgtcaccgtgctgccgtctgcatcagcttcaatgctgtggtcgacggaaagcgcctgatagcttttgcccatctccatcgtttccagcacttcttcttctgtaacgtcaagaaactcggcaatctcatcgactcttggagacctttgcgtttcagtcgttaaatgatccaccgccattttgattctcggcccgagctccttgatccttctcggaacgtggacgctccaggtcttatctcggagaaaccgtttgatttctccgatgatggtcggaatggcaaacgcttcaaacgattttcccacatcggggtcatagcgtttgatggctccaagcaatccgagcatcccaacctggcatagatcttcgtgaaagctttttccttttgaatattttttggcgagtgtttccaccagatttttatatgtttgaacaagggtcagctgagcgtcttcatcctggttctcctgatattttttaatcagcgtgtcgacttcggttttagttagtttcgtagttttggacggttgtgccatcatcaactcgctccctgtttaagaactttgtcatcgagacggttacgcctgagtcaatctggacatgcacttcatccatgagcgtctccattaaatataaaccgagccctccttctgacaattgatctaccgtatgctcaggggaatatggtccgagctccttctgtttatcctgaatatcaaaactgtctccctgatcggcgacgacgatttcgaggcggtcttcgaacacgccgaatctgacggagacctctcctgtgttgttgtctgctttataagcatgctgcacagcgtttgtgcacgcttcgctgaccgcaattttcaagtcttcgatgtcatcataagaataccccatcttgcttgcaatccccgacagggttaaacgaatgattcctacgtattctggtttggcaggtgacttcatttcaatgtaatcagctgctctcttcattataatccaccctctgactttccagaaatgtcaatgatgtcctttaaacctgtaatatcaaacaaacgaatcaaacgctctgacagattttcaagcactaaagaacccccagttctgtttaccgctttgtaaatgccgacgaatacacccagccctgtgctgtccatatatgaaacgtctttcagactaactttgagatcttttccttcttccgcgagcggcatcagctcatcccgcagtgttggagccgtgtgcacgtcaatttcgcccgcaacttttacttctatcacatggtcatttttattcgtatcaactgccaaattcacaatatcacctctggttctcttaatgagctactggtttattacccagcgaagagaagctttaaacctttctttttaaaacaatgagagtaaaatcatcatgaagctgaaaatcctgaagcttgagcagatgttcgtatatattgtcaaccatttgctgagccggtttctccatatgtacagtaatcaggttctgcaagtcagaccgctccaaaaacccgctgtctgtccggcattcagttacaccatctgaaaaaagaacgatcatatcgccaatatccagtttttgctcgtactgctcatagtcgtaatttgatgaaatgccaagaacgaggccttttgcgtttaaatcgtaaaatttattttccctgcaagaataataaaagccaggttcatgaccggcagatgaaaacgtaaataggtgtttttgaagatgatagttgccataaaacattgtaataaacatgcttgggtctacattttgttcgacgaccctgttcaggtttttcagcacctgtgaaggagacgtgcccgaatccggcagagagtccatcgcatatttgatcatcgacatgcataacgcagccggtattcctttcccgattacatccgcaatggcgatattaatcgattccttgtcgcgcacaaaatgataataatcaccgctcatttgcttggccggaatgctgaccgcaccgatttcgagcgcttcaactttcggaaccgtcgtctcaagcagcgtttgctggacattcgcggcaatttcaatttccgatttaatttcctgctgaattcctcttaatgtttgatgttcttgataggccaaaccgtatccaatcatcacttcaattaaaaaatcgagagaatggaacacatggtctggaagatccggatataattcagacagaacttttcggtgtatgctgataatctcttccggcggcacttgatgttcaatcgtttttctgctgaatttctgcccctgataaagggatgtctctgttaattcagatatataacggctaagcagctgtcgatagcgctgctcaatcacttccctgaaatccattccttccctcctaccgcagccattttacggcttgtatatccgttccattttccgcgtccgaatgcaattcaaattggtccatcagacgctttactcccggcaggcccgctccgaggccgcctgaggttgaaaaaccgtcttccatcacttttttgatgtcagcgattcccggcccctcatcctccgctacgattttcaaccccttttttccttcttcctgaacctgttcgatgcagattcggccttttccggcatacaaataaatattacgcgccagctctgagatggctgtcgtgattctggcctggtccactgtgccgaaccccagttcttttgcgacatttcgcccaagctgtctggcggccactatgtcccattcagtcaaaatcttcacacaggattggtctgccatatttattcccccaattcccgctgcaatgtctcgagccccttttcgagatcgagcgccgtctcgatctcgtccaaagaaatgccgagttcaatcaatgtcaccgcaacagccggctggatgccagtcagaacgactttggcgcccatcagttttgacattgtaatgacatcgccaaggactttggcgatgaatgaatcgatgatgtccactgaagtcagatcgatcaccactccgttcgaaccggtttcatatattttgttcagcaggtcctcttggaatttcagagcggtttggtcatcgagctctacttgaatggataccaataaacagttatacagcttcaaaattggaatgttaggtaccctcaaagattattcctccaatgaaacaatttttctgtctgtcatttctaatgcggttttaattcctttttgcagggtattttttgtaataacctgagttaaatcgattcccaaattcacaatcgtctgcgcgatttccgggcggattccgacgagcaggcatttagctccgacaagtctgacggcttcggaagcctgcatgatgtggtgtgcgaccatcgtatcgacgacaggcacgcccgtaatgtcaatgagcacgacttcagaccggtgtttgacgacgccgctcaacaggttttccataatctttttggcccgctccgtatcgatcgtgccgacaagcggcatcaccgtaatattttcaaaaaccgggatcagcggcgccgagagctcctgtaatgcgaccttttgcagagcaacggttttctcccaggagatcgcatactgattcaagatttcgctgttgatcggttcgataaatttatcgatttcccaaatcaaatcatagcactgctgatcttccggcacatccttgttcatttcatagtaaaggtgcttccaaaaagctgataatcccgacgacagcagcttcagcggaacgccgagctgtacggcttttgaagagaactggtagatggtgtcgatcgatttttcattcccgtccccggactcattcatgaggatatgaatatattcattgctgatcgtctcatacatgtgttcagtcagcttcacgtttgtcatgttgctgtttaagtctttcagaatatccgccaaattcccggcgagtacattttggtgttccgagataaattttaacaccgcttgattcgacatgttcatccccctgactacatctgataacattttttggactaacagttccattatatcgtttgttatttttgaacacaaaaaaagttgctctttcgcctcgagcaactttcatcaatattaaaaatcaatgagtgccaaactgatttgtaaggcttcgttgaccttttccatcatttcatcatcgagatgggtgattttgtccgttaatctttgcttgtcaatcgtccgaatttgttcgagcaatataacggagtctctttcaaaaccgtagcgtttcgcatcaatttcgacgtgggtaggtaattttgctttctgtatttgggctgttatggctgcaacaatagcagttgggctgaagcgattgccgatgttgttttgaatcactaaaaccgggcgcaccccgccttgttctgagccaacaacaggagataggtcagcaaaataaacatcgccgcgtttaacaatcaaatgattatcctccgcttactaagcgctctactgtgttttcagcctcatactctgcaaattgagcctcagaagagatgttcaaattgatcttggccatctccatataaccgcgtctcatcgattcccgaatttgtcgatttttgcgttcgcgtaaatacatttttgtggcttggtaaatcagttcatttctgctcccgttatcttgcatgacgacaccatccagttctgatactaaagcttctggcaagcgaatcaatatttcagttgttgcgctggattcagacaaaaacatacacctccaccaaacttacggatacaacactctatccattccattcataatcatatcattattcttttcgcaagcaaagttgtttttccgctaattcatcaattttcaggattgatcaggcaagatcggattccttatttccattatactcccattttccaaaaacatacggggcacccttgaacttatcatacaggtaatttcataattgatcgtctgcaaattttgggcgatttcgtcgactgagatccattcgtctttttgctttccgatcaaggtaacctttgtgccgacagggtattcttcggcaagggaaatcatgaactggtccatgcagattctccctgctattttttggcgttttccgtcgatcagcacttccgttccggccaggcgcctcagccatccgtcggcatacccgacggggactgtcccgatccattcgtcgcgctgagctgtatatgtcgccccgtagctgacgctctcgccttttttaatttttttcacatgggtgagttcggtatgaagcgaaaacacttcccgcagacgaaacggcagctcgtcttttatttcggttgacggcgccaaaccgtacatgccgatgccgaagcggacggcattaaatagctgttccctgaagcgcagacccgcggcgctgtttgacgaatgcaccatcaaacggtcaagcgggagggggctgatcagctctttaaagcggtcaagctgcatgttgaaataatcggtgtccttttcgtccgccgtggcgaaatgagtgaacacgcccgtacaattgagcttatcgctcgattcggtcatctccatcatttctttgatctcttcttccgttttgcagccaaggcggcccatgcccgtgtcgatcttcaaatgatattcaagaggagcttcggcctcattcagaaaaccgagcacgtctttcagccagccgacggagtagccagtcacgataatgcgcttttccgcggcaatgcttgcatattcgggcggcactgcaccgaggacaagaatcggttcttcaatcccctgcgccctcagcgaaagcgcttcatccagtaaagccacagcaagaatggacgccccttctgcaagagccgccttcgctacctgtgcatccccgtgtccgtaggcattcgctttaacgacggccatcaggtggacatgctcgccgatgtgccgcttcatattgcggacgttttcttttaaagccgttaaatcgatttcggcccatgtctttctatagaatggttttaagctcatcatgacacttcctgttccttgtttcactcgtccttcccatcatactaaaaagttcggagaaagggaaattttgcacgggatcatcagccctgaacaaaagaaaaattgctggcacggtatacattttacggaaaagctgtcgaaatcatacgcttgcgacgcaaatataaaaaagcctgctttccgcttccgggcggaaaacaggctgccggatacggcacagtctatttcgaagactgtccctgcatgctttttgcaaccatcagaagttcatcttgagaaagatcttctgatgagataaagtaatcgactccgtcatatgtccatgacaacgatttatccgtcagtgcgccgaccgtgaagccgaggtcaacgggctctccgttcatggatacggaagtggatgttttggcgacgcgggctttttcctgaatcaatgtaaaggatttttcaccgccatatgtgatgacgatccgtttgccgtcttcagtcgccatctctttctcctcaagttttttcacgccctgaggcacatcgagcggcgttttgacagcgaaagagtctgacacgtcagcacttgtcgctacgtcaatttgagacagcgtcatatttttcttttcatcaaaagagtctttatcgagcggcttatcgaattcaaagcttgtaaactcaacctttaccatcggtttgcggtcggtatccatcactttaaccgatgaaggagccatggtctttttatggaaaacgatttcctgagtcggcagcatctgattatgctgataattcgttttcgtttcaaaaatgtattttgaatcctttgcggaaaaagaagcttccccatcatttttgacatcctttacgagcgattcgaataagtatacctggctgctgttattgggccagtcgctgtgaaagcggaagcttttattcagcgacggagtcaaaacaaacacgccgttttcattgcgcaagatcacctggctctggtcttttttcgggttttccaaatagacccggtaaagagaaggttttttatgccagatttccacgttgtactcctgcggttcatttcccgtttcaatggtcattttcgcttttgccttataggacgtgtattcttttgccttcttgtcgagccccgtcacaacatcttcttgcgatttttggccgcaggcagaaagcataaggattacaagcagccccgttaaaagcaaaacaaagctttttctcaccttttttcaacccctttttaatcattgatgtaaaaaggaagaaaccgcttgttcgactttaacggtacgccataagaacagggccggctgtatcggcgtgcgtaccataaaagcctgcaacgactcgtctcccttattgcactacccaatatatgagcgtgtctcagacaatatgcagactagcatgacaaccttccaaaatcattttctcgtccgtactaatcgccgctgcctgttcataaacgtgttactatatatgtacgagatcattgtaaaggggcttaaatcataagcatgtttatcagaacagaaaattttcagacgtttatcaggctctacccggtcacatccgccatattggccctgcagcttgccatttggattctttttttatttccgtttacggccgtacagatgtggtctgatttattgattggctttaactggggaatagcgaacggagaatggtggaggtttgtgacgccaatctttattcacgccggtttcggccacctgctctttaattcgatgtcgatctttttgtttgcccccgggctggaacgaatgctcgggaaactcaagtttctcatcgtttatatcggagcaggagtgattggcaatatcggcacatatttcatcgaaccgctggagtatatgcatgtcggcgcttcgggagccattttcggcttgttcggcgtgtacctgtacatcgtgctgtttagaaaagagctgatggggagcgccaattcccaaatcatcgtcaccatcctcgccatttcggttttgatgacgtttgtaaaccaaaatatcaatatgatggcgcacatcttcggtctgctgggcggactcgccttggctccgccattgttaaacaaaagagtgaacggcttttaaccgttcactcttttttcatatgaataccatgcaatgatatcgtccgaatctttctcctcaacatcagccaccgaaaacttctccattaaaacagacgattttgttgatgtatgaatcgaaacaagctgttttctgcgctggaaatacgagcggctgacttcgaaaacctgcatgcgcctgcgttgaatgacagcggttgttctgccgatgaagcgcgatgacatgatgattttgctgccgctgatcttccatccggcatcgcggtatgagaaatagccgatgatccagtaaaaaggaatcaatacagcggacaaatagccccatggcggaaacagaatggaaagcggaacgacggcgagaaccggccaggatgcgcgcaggatatagcggcgcagcgcgcgtttcggcaagcggttcaaatcgtcttccggcgcataatccggaatgaattcgccgagacgctgattgattatttttttgctgatgattggaaataagatggctgatttatcttcttccaggacgtttccgcctgcgctgacgatcgtgacggctgcaagtccaaaaggctgcctgatcaggctctccttgattttaatcgcttgaatccgctggagcggaatcgtgatttgttgcttttcaatcagccctctggaaatgacgatttctttctctttacgcacgacagtaaaattcgcatatttcaaaagcatcccgacgatgctgagcagccatgcgatgaaaagggcaacaaaggcggccaatgcgatgacggcggcacctgcgctgttcaaaaaagcaaagcggtcatacagccaatccaaatcaaagaaatcatcgacttgagtgaaaaaagcgaatacccctgaaataataacgccgatgccgcttgaggttgaagcggcggttaagagctcctggccggtcattttgtacatcattaccggctcttccgcttcctccgcctcttcagcagtttcttccagcggaaccgggacatcggtccccgtgtcttccgccgcttttttcctttcgaaaagcgcttgctgaatacgttcggcttctgcctgggtaatggcgaccagggaaacttccgcttccgttcctccgcttgccgtttcgacttgaagcttcaccagcttgaacatttgttgaatgaggcctgcgcttgtgttgatcgtttgaatccgttcgatcggaatatacctttttttcttattgatcaagccttcctctattcgcaattcatcctcttcgatacggtatgtaaatttgctccacttgatgatgctcgtcacaaccaaagcaatgaaaaacagcacggccgcggcgatcgctatcattttgactgtttgcgattgatttaaaaaaatcaccacgccaaatggaatgataaaatttttaaccgtctcaacaaggcctttgataaagttgagaatgacggcggcagggtgcatgcgtctcggttcagacatcatcttcagtcacccttgccagcctggaaatggaatctctgagctgatcggcctcttcaacatccaaagcgggaatggaatgggtcgtcgctgctgttgaaatttgcacggaggcgagattatattttctgaggatggggccctgcgatgtatcaacatgctggactctgaccatcggaacgatcacgcgggtcaccacaaagatgccgtgctgaatatcaatttcgttctcatggacttcgtagcgccagactctgtggcggatattcggaatcatgataatgatgacaaatgaaatccccagccaaacggccgctgacaaaatgccgatccataccggccacttaaatatctccccggcggcaatcaggcctgctgcagccagcattaaaacgaatgatgtgatacaagccgtgattctccagactttaacgccatcacggctgatttgatttttcggctcgcttctcaaaactcgattcccccaatctcattctatttacggtcttcggtctgaaaatgtttcgtttaaaggctttagtttttaaaaaaaggcgaatccgtaaaaaaggatccgccttttgattatgaattatatgattttttttggcgtctgtcattcgaagaacgctttttatcataagatgaacgattgttctttcctctgtagccgccgccgtctctgcgttttgatgaacggtggtggtggtttttgtttcgcttcgttctgagcggagcctcttccgtcaaacggacaggtgtgttgtccggctctttagtcatcattttaatggcagccgcaacaactgtcacagaatcatggtcttccaataattccgctgcagccgtcatatagaagttcaggttattttcctcgatgatcgtccggatgcggtcaaccgtcacctgctgctgtccttcaatggcctcatcgagagtcggtgctttcatgcggtccattttgcgttttgtcgtctgctcgatggcgcgcagcatatccttttcacgcggtgtaatgaaggtcatcgccattcctgttttgcccgcgcgtcccgttcttccgatgcggtgaacatagctctcaggatcttgcggcacatcgaagttgtagacgtgcgttacacctgaaatatcaaggccgcgagccgcaacgtctgtcgcaacgagcacttcaatcgcgccttgcttaaatttccggagtgcaaccatccgcttcgcctgggtcaaatctccgtgaattccttcagctgtatacccgcgcagattaagcgcttctgtcagttcatcgacacggcgctttgtccggccgaatacgatcgccaattccggagactggatgtcaagaaggcgtgtcagcgtatcaaactttttgcgttcatgaacttctaggtagaactgctggatgtttgatactgtcatttcttttgctttcacttttacgtgctccgggttggtcatgaaacgttctgcaatccgcttaatcggagcaggcattgttgcagaaaacagcaatgtctggtgttcagcaggcacattggaaaggatggattcgatatcttcgatgaatcccatgttcagcatttcatccgcttcatcaagcacaacggtgttcactgtttgaagacgcattgtgcggcggttgatatggtcaagcagacgaccaggtgtgccgacgataatatgagggtttttcttaagcgcgcgaatctggcgtccgatatcctgtcctccgtaaatcggcagcacgcgagcgcgtttatcctgtccaattttatatagctcttcagaaacttgaatggctagttcacgagtaggtgcgataacaatggcttgaatgttaggagactcggggttgattttctcaacaagggggatgccaaatgcagccgtttttcctgttcccgtttgcgcttgtccgatcacatctttatttgcaaggccgagtggaatcgtttgtgcctgaatcggtgttgcctcttcaaatcccatacgcttgattgcttttgtgagatcagaacttaattgaaaatcttgaaacgttattgtcaatgtattcaaactccttctgcttactgtttcagtaatcgtgttttatcaataaaaactgccctttgtgcaaaggacaggttcatacttatgcaaagcccgaattactttacatgttatattaccattccattatacgtttttcaacaagatgagaatgagcggtgtgctctctcgccggttcggcagtctcctatgaacctcgggcgaagccgtccgtccgcgcaactaaagcccgcccgaaggcgtcctttacacattgtaacacaggcatgtgctgctttcgacagcatacgttcattttttccctgtcagcatcccggattattttttgcagatttccgttcaattatttatttttttatagattcaatcggcgtttttttgaggaacgcctcaacggtttgaaataggatagaggagttttcttcaaggcagacatggtgcttggattccggcaagaggcacagctctttttcttcggaaggaatggtttcatacaagtaatacgcgcttgacaccggcacgatggcatcacactccccctgaacaatgagcacagggatccggaggtttttcaatgcaggctttgtcatcttgacgagcttgcgaaactgaaatgcagaagacaccggagtgcttgtcagcttttgtttgtaccttttgtaaagcagattatcctctagcttgccttgcagtgaatctttgatcacattcttcaaatcctggatcagctgtcccgggctgatgtactgggcggccgcactcaacaggacaaggcggctgaccggatattttccggctaaatagccggcaatcatcccgcccattgaaaatccgattaaaaataccgtatcacacgttttcaacaagcggatgagctccacttcagcacaagcgatccattcctgaaaacagacgccttttaaaaccggcatctcaccgtgcccggggagcgtgatcatttcaacttgccaatctgccgtttgttttaaatgagaagccagcggttccaattcatacggcgctccggtaaatccgtgaatgcataaacatcctatcatgaccattcacccgttttcttttactgatcatcacataaaaaacgactttatgattcaaagttcccttacaaatcttttataacatcctcaaggcgcatgcctctggacgctttgacgaggattaaatcccctgtattcgctttttctttcagtgtctttttcaaactgtctttttcttccgggttgaaatgaaggacgcggtgttccgggaaatgtttaagcgccccttttgcaatatatgcaccgagttctccatacgtaaataaaaagtcgatcgagtccgggttgaccgcctgcccgatttcttcatgaaacgctttttctccttctccgagctccagcatatcgccgagaacaagaatcttcttgccgtatcccttcatctgttcgacaagctcgatcgccgctttcatcgatgtcgggctggcattataggcgtcattaatgatcgcaacgccgtccggcgtctttactagctcaagccgcattccggtcactttcagtttagtcagcccttctgcaatgtgagcgcggctgacattcaagaggtctccggccgcaatcgcggctaatgcgtttttcacattatgctttccaaggaccgggatgaagaacccgttttcgattcctctcacgcggaatgccgtcccctcttcagtctgtgtcatatcctcaagctgataatcgaaagccggatcctctccaaacgtctttgtatcgtaaggcggctggttcagcctttcggtgagcagcggttcatctccgacataaatgagtgtgccttcttttgaaagcccattgacaatttcgagcttcgcctctgcaattccttctcttgatccgagttcaaggaggtgtgattcaccaatgtttgtaatgactgcaatatcaggccgcgccagacgagtgagaaaatcgatttctcctttggcgctcatccccatttccaaaatggcgacttctgtgtcttcgggcatcgccagaatcgtcaggggcaggccgatatggttattgtagtttccttctgtcttatgcactttatactcagtgcccaaaacagcatgaatcatgtcttttgtcgtcgtttttccgtttgaaccggtcacgccgacgacttttacgtccagctgattcctgtatgccttcgcaagcttctgcagcgcttccagcgtatcgtcaactaaaatgaccggcttcccttccggaggattcggttcacttcggttccacagcacggccgcaacgccttcctgaaaagcctgctctgcaaaaacgtgtccgttgaaccgctcgcctgcaagcggaataaacagttggcctttcgccagttttctcgaatcggttgagacgcctttgatgagacgcccttcaaaagcttcattcgtcaaaacgccttccgacatttcagcaatttcttttaccgttcttgttatcatgtatgtccctctctttcttctgcaaggaaaagagacactaccacaaataaggatagtgtctgcagctgtatctaagggcgaaccgccttcagcgcctttctccatgaaagctcccggattcggtccgctccgtcccgttaaaatgtatgtttaatctgctgtttttcttcgtggcgctcgattgccaaagcgacaagcttttcaatcagttcagcgtactcaacccctgattgcttccagagaagcggaaacatgctgaacggggtgaatcccggcatcgtattgacttcattgatcaggaccctgccttcatttgtaaggaaaaagtccgctctcacaaggcctgaaccgtcaatcgcctgaaacgctttgaccgccatgctgcgcattgtttcgtattcgtcttctgtcagggaagccggaataatcaaatcagtatcgccgtcttcatattttgctttatagtcataaaagtctttcttcggagcgatttcccccgcgactgagcagacaggttcatcattccctaaaacgccgagttctatttcccgtccgatgacgccctcttcaacgacaattttccggtcatattggaatgcaagctcaaaggcttggtcaagctcttcacggcttctgcatttgctgatcccgacgcttgatccaaggttggccggttttacaaagcacggatagccaagttccccttccacttgagcatagcattcttctttagactgactccaagtttttttcaaaaatgaaacgtatttcgcctggtcaagacctgcctgtgcaaacagatgcttcatgaccactttatccatgcccgcagaggaagccaagactccgttgcccacatatggcacattcaatagttcaagcatcccttgaatggtgccgtcttccccattcggtccgtgcaaaagcgggaaaacaacatcgatagagtcttcttttgcatcagcttcgccaggaaacatatcgcggttcaacacagccggagaaaatgtctggcccgtctgttcaaattgcagcattttcacatttgaaaccggttctgtcagttgcggccctctcacccactcgcctttttctgttatataaatcgggtgtatatcaaatttttcagtatctaatgctttcgtgacggccagcgcggtttgcagagaaacgttatgctccgctgattttccgccgtataccaatcctaatcttgtcttcaattcgtactccccccactggattcatctttactatcttatcactttcccgggaaaatgatctaattattttaatacggtctaaaaacagcatataaaaagcatttgtatgtaaatccttttcattttatattaaaatggcattgaaaaggagaggttgcaattgaaaaaaatcacaacagaagcgcaatttaatgaattgatccaatccgataaagaaatcatcgtcaaattttacgctgactggtgcccggactgcacacgcatgaacatgttcatcggagacattcttgaggcttatcaggaaaatgactggtatgagctgaataaagacgaccttcctgaacttgccgacaagtaccaggtcatgggcattccaagcctgttgattttcaaaaacggcgaaaaaacgggacaccttcacagcgcaaatgccaaaacgcctgaagaagtgaatgaattcctggctgaacatattagctaattcgtttaaagtcctgattttttgtctgaaccgccggacatgggagcacccccatgtcctttttatacaagacgggacagcagcaaaatttgtttcataaaagaatgagctttaaaaaattcgacacgagtatttcccgggaaacttaaaatgtcgaaatttcataaaaagttcttgattcgttttttatattccggtagaatgttttttgttcctattttgcaattattttttctagttgtgaagcccttgtcggcttctttttttatatattcttttggataataattcatatttttcgattttattcaatattctttcgaagatgtcgctttacattcggtgatcaggtttagtataatgcaattaattgataatgattatcaatatcactaatggttgacgaggtgatcacatggcccctcaattaaagaaagcggtggaaatgagaaagaaacaactcattcagcgtcttatccagcttggcatatataaaaaagaagagcgccacctctacgaattgtctttaagcgaacttgaaagcgaataccaatccatcaagaaaggcggataaacatgtcaaaacggaagattaaaacctttcatcagcttgtcgaagaatataaaaaagaaatcgccaagaacccgaaagaaatggaagtcatttatgacaagatcgaccgcagacacgagaaccgccttttggccatttcaaaagcaaaacaaacataaaaaagaagccgctgattttgaacggcttcttttagcggatcgacaccccgctaaagcttaaagaatgacaaaactattcgctgaatgcaattcctgcaagcttggcgattgtcgcatcatccatcggcgggttgtggaggcccgcccggacatcgcggtagaatctttggagcgggttcgttcttgcgagacttttcgctccgacgactctcatcgccttgtctacgacagcaatggccgtattcgttaccgtgtgcttaaccgctccaagctcacctgtcaaaagggcgcggcgctccggatcatcataaagctctgcaacatgatacataaagtggcgggctttcatgagttccagatcgatttcgccgatatggcgctgaacagcgggcacctctttgatcggacctttcaagctgttcggctgatagtcttttgcaaattggacagcatagtctctcgctgcttgtgcgatccctaaatagacagccggtatatgaagcagccagccgttgattttatcggttcttttaccagccaacagttcaacaagcatggattcgtccagacggacatcggtcagcaccaaatcgtggcttcccgtgcccctcatcgccgccatatcccacgtttcttctattgccaagccttccgcatctttatggatcaagaaaacgccgatcatttgcttctcttcaatccaagcggtgacaagaaaatagtcgagaaccggagacatcgttgtgaatgttttacggccgtttacaatccagccgccgttctttttgactgcatgggttccggggcgtcctcctcttgtcgggctgcctgtctgcgcttcacttgcagctctgttgatcagcgcgccctttaatgcttcatgggaaagcgatgaaaacacatcccggtcccagctgtttccctccgccagttcccccatcacgcttaagtgccagccgatgctgagagccgtcggtccgtctcctttggcaagccgttcctgaaacaaaagcatatcgtagagcgaaatgccttctcctccgtaatcttttccgaccgtcagcgctgtgtagcctgaatcccgcagcttttgaatatgttctgcgggaaattgtgcatgttcgtcatagtacgctgctgttttctcaaattcatccgccaattttccgattttatcgagccattcctgctgcctttccgttttcacaaatattgaacacacgccggcatcctcctgaccaaattccgatagatttaataagtattatagttcgttctcggctcgttgtgcaaatgatagccttggcaaaacaaaaaagcccaccttcagcgaggtgcgcttttgactaaacggcttgaccgccgcggcggtcaaccttcataccgagataaatcagcatgtaggttaagtagcccatcgtgatcgtgaggccgccgaagaagaaatcggaaaaaagcggttcttcatatgcggcgattccggccagcacgatccagcttccataaaggtatgccataaagaggcggacgccgtttttcaatttatataacagaaacaaacctgcaagcgaaaatagtccgagcgcaagtctaaaatatacgagatgatcaaagttaaaggcaaaagaaacaaatgaaaatgacagcagcaatacaatcggcaacgccgtaataaactttttcatagatgtctcatcccccattcccttcctaaaattataattgagaataggagattcacacggtaattacgacatatttcacaaaaatgtcattccttttgtcacactttggacaattatttataccttcatatcgcgtttgcaaaagccccaccatgccgttccgagaaaaaacacgagatggataaagacgatgaagagcgagaataaaggcgtcatcccggcaaaaagcggctttgcctctccggcgtactgcgttaaatcggtattggcgaacaataaaaacttgccgagcggcttttccaaatacgccataatcgtcacaagcattttggcgccgtacagcacgacaatcgacaccatgatgctgagcgcgctgcttttgaataatgccgagcataaaaacgcaaatgaaaccatcatccatacttcaaaccactgcgtcccgatcattttcaccgtattgataaagagcggctccgctttttcgtcgagcttcacgccgaaaaagagcaggccgaacaatatagaaaatccgtagtaaataataaaaagccaaatgcttgcgagcacgctcgtcacgtatttagaaacgagaatcttttctcttctgacagggcggatcagcaaaaacttgatcgtctttttatcatattcaaaggatataattgaagccgccaccacaatcgaaagcccctgcaagaggatattcaggtttggggtgaatgaaaaatagccgataaaatgatcctctgccccggcgcccatcaggattcttttggtgatgagcgcgaggagaaattgaaagactacaatcagcgccagcgatacaaatgttactttgcgcttcagcaatttaacatgctcgttttgaatcagtttaaacatcagcattcctctcttctattccattcgtccgcgccatatattcatcctcaagagactgcttaaacggagcgatcgaatagacgtcaatatcattggcgacaagctgttgatttaaagccggaatttgcgctttctccacctttacggcaagcaggcctttttcggtgcgagcttcgtatccttggtctttcagccactgaagcgctttgtcatgaggctgtacctccagcatcgccttttcctgtttctcgtccgcttgattaaggacgacagttgatttgattttccctttttgaaggatgacgacccggtcgcataaatcttccacttccttcagcaagtgagtcgcaaacaggatcgccgttccttcttcttcggcgagttcacgcaagtgttcgcggaaatctttcattcccgccgggtccaatccgttcgtcggctcgtccaaaatcagcagttttggccggtgaagaatcgcctgggcaataccgaggcgctgtttcattccaagcgagtatgttttgaccttgtcttctgcggcatcttcaaggccgactctgctgatgacttcctccagtctttcccgtccgattccagcgtgcatatttgcatagtgcttcagattttcatagcctgtcagatacggatagaattcaggattttctacaatggctccgacggactggatcgctttttcaaattggcggtcaatcggaaagccgtttatgacaattgatccgctcttcattttgattaaaccggtgatcaatttgatgagggtcgtttttcctgatccgttcggaccaagcagaccgatgatctccccttcatccgccgttaagcggatatctttcaatatcgttttgccgtctatgattttatcaacattttctatatgtaaaacaggctgctttgtcatagccccctcctctttccaaaaaaataaacagtgccgaaaaggcactgtttgattatatcatttcttaagttacacggacacttcactatgaggggcttcgattttgccgtgtttcttttccgtctcggtgacgatgaccgcacatgctgcatcgcctgttgtattgacagccgtacgaatcatgtccagaagtcggtcaattcccaatattagcgcaattccctcaactggaaggccaactgtttgaagaaccatggcgagcataatgagtccgacacccggaacacccgctgttccgatgctggcaagcactgccgtgagaacaaccatcaacagctgtgtgagcgacaggtcattgccgtacacctgagcgataaagactgttgccaccccttgcatgatcgccgttccgtccatgttgatcgtagctccgagcggctggacaaagcttgagatcggctctggaactttcagctttctttgagcgacatccatcgaaaccggaagcgtcgcgttgctgctggacgtactgaaggcaacaagcataacctctgaaaaatctttaaagaatgtgagcgggttccgctttgccagaagcgcaatcgctgcgccgtatgtgacgatggtatgaatgaacagcgccagaataacgacgatcatataaagccccattgctttaatggcgtcccagccctggcttccgattgccccggcaatcaagccgaacgtaccgtacggcgcgaacttcatgacaagattgaccaggtacatcatcagatcgttaccctgttcaaccactttgagaagagcgtccgcttttttgcccagcatcgtaattccgagaccgaccaaaatggagaaagcaatgatttgcagcatatttccttcagccattgcctgaaccgggtttgtcggaatgatattcaaaagcgtgtcagaaatgcttggcgctttctgggctgaatattccgcagcgcttgtatcatatgttccgatcgttccaggtttgatgaccaacgctaaaacaagtccgataataatggcaattgcagtagttattaaaaagaaagaaatcgttttggcaccgattctgcccaatttctttggatctccaagtcctgctacccctaaagtcagagaaaagaaaacaatcggtacaacgagcatcttgattaagttaaggaagatcgtgccgagcggcccgaataaaaatgtattaagcttgctgaataaatccggtgaagtgacgttcagtataataccgacgactgcaccgagcaatagagcgataataatttttgttgctaacttcatataacatatctcccctttctaaaaaaagcccatgagagatctcccacgggcttttaccattaaaattggttccacatgactctcttcacgttgatgaggttagctgacgggttcggacgaagagatgtccgtctttcggttcgcacgggaacagaaaaattcaccccaaatgatcgggtcccccactcctactaaaggattaaacgtgtggcgctatttcgttatataacagttatacctgaaaattcgaaatatgtaaaccgaatttttcgatttacaaatatatgctattttcgtgtgcctgctgttcggtttttctcctgatttgtaacatcaagtatatcaagcaggaaaacaaatattggaataccgataattaaaccccaaatcccaataaaatgttcagaaaaaatcagcacgataaacgtgaagaaaatcggcagctccgtctttgcggacatcaatttcggattgaggaaataggcctctatcgcatggacgatcatgatgaccaataccagtgatacgatataagcgattccgccgatgctgtaggcgataatgcttaacggaataagggagagcacaacgcctgcgaccggaaccagcccgaggaaaaacaccatgacggcaaggccgaaaagctgaggaaaacccataatggcgagggcaatggtcgtcagtgcgcaattgatggtggcgataataaactgagcctcaagcaccttgccgaacgttctcgtgaattttttcccaaagtaagcaatttcctcgtagaaaatagctattttgctcgtcttaaatttatccattaagctcatgactttgtctttttcgatcaataagaacatgctgagaaccaatgacataaccacctgcaggccaaacgtgctgatatccgtgatatatgtatagataaagttaagacccttttccaaataggatgtcaaattgatatcgccgaacataccggtgatcatatcgagaaaaggaatgctgtcagggtgagaagcgatatgctttccttgtttgatcagctgctgaatctgggtgacgattacggggtaatagaccacaccgccgatcgaaagcgcgatggcaagagccgcatacaaacaagaaataatcagtctctggctgactttaataaagcggtttaaaaaaccgcggatcacattttccagacggttcatcaaaaacgtaaagataaatgtgagcaatatgagattcatcatgctgcggaacagatataaaacccccgccaatacaacaaaaactgaaaaacgcctgaccccaggatgctgaaaaaatttaatcaacgctgccattcggtacactcccaccagtactttagtccttaacttttagcattcaaacttttataactacaatttgatgcatcatctgtaaattatataacaaaacagaccggaaatctcttcagaagatcaataatttataataatttaatatgggcgttcaagcggcagcggcaggcatcttcataaaaagagaggggctgtttgtcagcccctctcttcaccgcacattaaccgcttcttctttggcgtccgcctttttcgccgttttcttgatagaactccttgtcatggttgcggcttgtggcttctccgcccttttcaccgatttcttggtagaattctttatcatggttgcggcttgtggcttctccgcctttttcgccgatttcttggtagaattctttatcatggttgcggcttgtggcttctccgcctttttcgccgatttcctggtagaactctttgtcatggttgcggcttgtggcttccccgcctttttcgccgatttcctggtagaattctttgtcatggttttggcttgtagcttctccgcctttttgaccgatctcttggtagaattctttatcatggttgcggcttgttttttctccgccttttctgcctgcttcttccctgctcattttgttgtcgtcattattgtttgccatttttgattcctccttttgaagtgttatggtttttacattccacatttcaaaaagagtaaacacaaatagcacattcacgaaagagagtgtggatcgcgcaatcgtccgctgcccattaccgtccattccggtaccggagccggcgtattgttctgcagcgtttcagatatctcggcaggatcttcaaacagcgtaatgttgatggattcgaatgtgcctttctgatgcgttctttcatatatctcatcatgatgttccgccataaagttcaaataatcgtgcttcgatttccaaagcgccaggacgacggcttccggcccgtcttctgtttccatccatccgccccactgcctgatgaatccgctgacgttttgcagcggagcccatttggcctgcgcctcgctgaatgcttgaagcttttgttcggctgatttgcaccgtatcagcttcagcacattcccttccgcgaacgggacggtttccgcattagttttttctatacaaaggttaaccgacctgacatcagcgcgtgtccggtgaatgacgcctttcggaatcagcagggaatcattcgctttcagaacttctgtggggcgatcctgaaaatcgatcaacagctccccttccaaaacaataaacagttcatctgagccgggatggatatgccatacgtattcgccctccaaaacggcaattcgcatacaatggtcgttcacttccgaaacaagaaaattggcgtgcttttctgcgacttcctttgtcaattcaagaagattcgttttgcgatccatcggcttcccccgcttttgatttgattttctccagaacttattttaccatttgacttttgcgcgtgcgccttttaaagtgttggatattggtgaaaaaacggtttgaacctacagaagaggtgtacatcatgcaaaatcaaaacggaaaagcctcagggcttttgccgctgtttttatttgtttgtttattcgttggatcaggcttgatcacaggcgacttttacagcctgccaatcgtggccgcggcgcttgcggcatcggttgtctcactggcgatgaacaggaaggagaagctcagccaaaagacggagtggtttgcgaagggcgccgggcaccccgacataatgatcatggtgatgatctttattttggccggagcgttttcatcagccgcaaaggcgatgggggccgtcgaatcaaccgttaatctcgcgctttcatttgtaccggggcagtttatggttgccggtttatttatcatcgctgcgtttatctctgtgtcgatgggcacgtcaaccggaacgattgctgcgctcgctccgatcgcagcggggattagcgctgaaatcggcgttccggcggcatattcggttgctgcggttgtggggggcgcgatgttcggcgataacttatcatttatttccgatacgaccattgccgctgtccgcactcaaaagacgaaaatgtcggacaagtttaaaacgaatttcctgatcgttctgcctgccgcggttgccacggtcattctgctgatggtgttctcagccggagggcatcccggagcacaagccgggacttacagctgggtgaaggtgctgccgtatctcggggttctgatatttgcccttctcggatttaatgttatggccgttattttcggcggcatcgtattagccggggtaatcggaatttccgacggaagcctgacgcttcatacgtatttgacggcgataaccgaaggcatcggcgggatgtctgaactgatcattttatcgcttctgattggcggaatggcggaaatgatgaagcgaaacggcgggatcgcgtttctccttcaatttgtatcgcggagaatccgttcaaaaaaaggagctgaagcgggcattgccggccttgtcagcgcggcaaacctggcgacggccaacaatacgattgccatcattacagcggggccgctggcaaaagatttatctgacaggtacggaatcgacaacaggaaatcggcgagcatccttgatattttttcctgtgcggttcaaggattgattccttacggtgcacaaatgctgtcagctgcacaaatcgcgaaaatatcgcctgtcagcatccttccttattctttttatccgattttaatcggcgtctgcggcatttgcgcgattatcttcagactgcctcgctttacagaaaaagcgtaactctataagaaaggctgccgttatcaaacggcagcctttttatccctctgtttctgtcgcgtccagctccgcaagcctttccatgatgcgccgctttttatacatcatcatccctgtttcggcaacaccgttcaccatcgaacgatttgagattgcaccaaaaaggattcctgctactggcaccatttgaaacagctttttccatccgaaagaatcgcggtatgtataaacaacttcccgccagccttgaatttgcgaaatcatattttcacgggagcctgatggttgatggtatcggctgagttcctgaatgatcgcccttttcccgacaatatcagcagcgctgagctgcagacatttaataataaacatccgctccgttttttctttaggatcgtagccgtaagataccgcgatgtcctgcaatgtctttaaagaaaggccgaggattgcgggaatatcgacggcaagcgtgaacaagccgcccacaccggttgtcgctccttggactgctgcggtattcgccctgtttttcccgagattttcacatatttgatccatcacttccaaaggagcccattgaatatcttcaatcgtttcgatcgtttcatccggcagctttttttgaaactggcggatcagatgcttttcggacgtcaaatattggcctccattttgaataaagccgccgatttcgtctagcagcaggccgattttatcttgaatgaatgccggcgtaagcttgtccagaactttgaacggcagccggccgatcctttcccaaaaccatgctttctgctgttccttttcccatttttcaatttttttcagttcgttttccaaatctgttttgtcgtagcgcacggaaggttcgccctctcatttgtgtttttttatagtatacaatgattcatctgatgaatccgtgttttttgatcggcatccagcgggtaaaactttatgaaaaaggaggaatggccaaatgccatggtcaatggaagactatcctgcttcattgaaacatttggacaaaccggtgaaaaagaaagctattgaaattgcgaatgcgatggttgacgaaggatacgacgaaagccgggcaattccgattgcgacgagtcaggcgaaggaatgggcggataacagaagcaaaagcgagcttaaatcctatgcagaaaaagccgatgaaacaaaacgtggtgacagcggttcgagcagcaggccggagcttgcggaaaagtgcgagcatgtcatcaaacatgaaaaaggctgggcagtcaaagccgaagacgctaagcgggccagcgaagtaaaggatacaaaagcagaagccgtcgaacgggcgaaagaaatcgccgaaaataaaagcaccgccgtcgtcgtccataaaaaagacggcagtgttgagcggaagatcaggatgaactagcgagacgctccgtttttggagcgtcttactttctccccgccaactccaatacagcatcagctgctttttgatagccgccggcattgcggagcgagcggccgattttggcggcgccgtctttaaaggagcggttttcaagcatatctttaatcgttttttgtaaaacagccggggaaagttcatttttgtccagcttgatcccggcgcctgtacgttccacctgatcagcgacgaaaaactggtctgcccccatcgggatgacgatgagcggtgtatcaaagtaaaggccttcatttgtactgttcataccgccgtgtgtgacaaatacatcagcttgtttcaaaacctccaattgcgggatatacggcctcacgataaaatgatccggtatgctgccgagatccctaggatccgttgatttcccgacagacatgaccaccttgccgtcaaagtctttcagcgcttcgatacacatatgatacagctctttttgctgattaaagatcgtgcccatcgagatcacgatgacggtttccccctccagctcggcgaacgggaagcttcccggatcctgcctgctcgcaatcgacggccctacaaacaaatagtcacttccaaatcgttcggcatgaggctgaaacgctctggaagtaaagacaatcgtgatatcccccggacaggagaatacgtcaaacggcttgtcgagactgacaggataccgctcacttaattcgccgagggctcctttcaatttttcaaaataaggcgagctttcaaggtcgccttgcggggtaaacgtttttgaaaactgctcgtccattgcaaatgtcgtgcataacgaaacgcttggcagctcaagcatttcagcaataattttccccgctaaaaagtgatggtcatatatcacataatcataagattcactgttgacttcccggtagatgaactgaacgatctcatcgactttacctgacatattgtaaaccacttcggcaaagtccatcttttcttttttcttcccgggtgatagagcctctctgaaatccgggtataaacggacttctgcgcctgtttttttaattttttcagcgtattcctcaactgcataatatacgatgctttctcctcgtctttgcagctcctttgtgacgccgatagaaggattgatgtgcccttcccccgggaaattaatcatcagtacatgtcccatcatagatcttcctttctcatacgaaaattttatataaggaaatttactacaaatagataaatgaagtaaagaaatttaattaagttaataataaataaacataattatttgaccatttgtctgtttcttcatatctttcctttaaatttttttggcatgcaaatgagcgtatgtcattagataaaacaggctttttattacttgacagccccatgtcggaagacgattttcctttttttaaaagcaaattaaaacatggcggatcgaggcacaatacatcataagaaacaacctacggaggttttgccatggatacgaaagcaaccaggatcgagaaggattttctaggtgaaaaagaaattcccgttgacgcctattacggcgtacaaaccatgagagccgtggagaactttccgattacaggctatcagattgatgaagagctgattaaagctttggcaatggtcaaaaaagcggcggctctcgccaacatggatattaaacgtttatataaagagcttggcgaagtcatcgtaaaagctgccggcgaaatagcggaagggctctggcacgagcattttattgtcgatcccattcaaggcggcgccggcacttcaatgaatatgaatacgaatgaagttatcgcaaacagaggtttagaacttttagggaaagaaaaaggggattacttccatttaagtccgaacacacatgtcaatatggcccaatcaacgaatgatgtgtttccgacagccattcatctggccacattgaatcacttaaaacggctcttatcgacgatggagcatatgttggatgccttccgcaaaaaagcggcggaattcgattcagtcattaaaatgggccgcacccatcttcaggatgccgtcccgatcaggctcggccaggaattcgaagcctactcccgggtgatcgaacgcgatattcagcggatcaggcagtcgcagcatcatctctatgaagtcaatatgggggccacggccgtcggcacaggtttgaacgccgatccgagatatattcaaaacgttgtcgcgcacctctcagatattagcggctatcagctgaccggcgcagaccatcttgtcgatgccacacaaaacacggatgcctacacagaagtatcggctgctttgaaagtcggcatgatgaacatgtccaagatcgccaacgatttacgtttaatggcgtctggcccgagggcaggtctagccgagatccggctgccgccccgccagcccggctcctccatcatgcccggcaaagtaaatccggtgatgcctgagctgatgaaccagatcgcatttcaggtgatcggcaacgataataccatctgccttgcatcagaggcgggtcagcttgagttaaacgtgatggagcccgtgcttgtctttaatttgctgcagtcgattaaaatcatgaacaacggatttcgcgtatttaccgattactgcatcaccgggattgaagcgaatgagatcaggctgaaggaattcgttgaaaaaagcgtagggaccattacggctgtcaatccgcaccttggctatgaagccgccgcacgaattgcgaaagaagcgatcgccacaggacgatcagtgcgcgagctgtgtttgctccatgatgttttaacagaggaagaattggatctcattctggatccttatgaaatgacgcatccgggcatcgcaggcgcttcgcttctcgaggaatagccatccgtctttctcaatatgctttcaagcgtttatagacgcccgagacgggctaaacatttaatataaatcaattgaaagagggtggaaagacaatgttaggatttctcgtttctttaatcgtagccattgtcatcggattaatcggaggtgcaatcggaggccacggtgcaccgggaggaattatcggctccatggtcatcggctttatcggagcttggatcggccacgggctgtttggtacgtgggggcctgatattgcgggattcgccatctttccggcgattatcggagccgcaattctcgtcttcattttaaacctgatcttccgcggaagaatgggttctcaagcataacttccagccagcatcgcccgaaagcggtgctggtttttttgtttggccgaaaccattctcgcatatactatagcatcttatggttgacaattgatcattgcgggcatatgatgatgatataaatttgcactaaggaaacttttatgtacaaggaaaaacaactgagaatataggtgaataaaatggtcagtcacgatttgtccaaacactcgcaaatatcaaaagaagcccaagatgcactggatggaaaaagcaaaggcttcaaaaggctgctcccttttttgggtccggcgtttatcgcggctatagcctatattgatccaggcaatttcgccacaaatatcgcggctggttcgaaatacggctacttgcttttatgggtaatccttttttcaaatattatggctttgctgattcagtcattgtcagccaaactgggaattgcaacgggtaaaaacctgcccgaagtcgcccgggaagaattccccaaaccggtctccatcggcttgtggattcagggagagcttgtcgtgatcgcgacggacttggccgaatttatcggagctgctctcgggctctacttgctgttcggcataccgatgcttgaagcatcgattattgctgccgccggatctttcgccattttggaactgcaaaggcgcggcgtcagaccgcttgaagcggcgataacaggaatgctgttcatcgtcgtgatcgcatttgcctttcaaacgttttttgcaaaacctgatatcggatcggttttggagggcatgtttgtcccccgcttcgatggtgctgacagcatcctgctggcggcgggaatcttgggagcgacggtgatgccgcatgccatctatcttcattccgctctcacacagcgaagagtggtcggaaaaacggaagcggaaaagaaaaagatattccgctttgagttcatcgacattttgatcgccatgctgattgccggagcaatcaatgcgagcatgctgatcgtagccgctgcactgttttataagaacggcattttcgtcgaagaccttgatgtggccttcagccacttcagcagcatggtcagtccgctttccgccgtattgttcggcgtcggcctgttaacagccggtttatcaagttcgtctgtcggaacgctttcaggagatattatcatgcagggcttcattaatttcaggattccgctttatttaagacggttcattacgattttgccgccgatcgctattattgcttcaggggtgaatccgacaaccgctcttgtcttgagccaggtcgtcctgtcattcggcatcgcctttgcccttatcccgcttatcttatttacgagcaataaacgcattatggggagcctgaaaaatgcaaagtggataacagccgtctcatggctgatcgctgccttaatcgtcgccctcaatattttcctgatttacgatacattttctggttaaaagtcggcctcggtcggcttttttatattatactgagaaaaagggggattctggatgtttaaattaatggtacgtgatgatctgtatttaaaaatgctcgaaccaaaagatgccagggccgtttatatgcagatccaacagtctaaagatgtgttgcggaaatggctgttttgggtggacggcacaaagcagctggaagataccgaagcttttatcgaagaaagcatgaaacaggccgctgcaaacaacgggtttcaagcgggaatatggcatcaaggccaatttgccggaatcatcggactccattacattaactggatcaaccgcacgacttcgatcggctattggctcggggagccttttcaaggaaaaggaatgatgacggatgcctgccgggcgctgatcgatacgcttttcagcgaatacgatttaaaccggattgaaatcagggccgctgttcaaaacgtaaaaagccaggccattccggaaaggctcggcttcacgaaagaaggctgcctcagacaatgcgagtggctccacgaccacttcgccgaccatttcgtatacgggcttctgaaagaggaatatgaggcccgcagcaaatgagtccgggatttgtcacacgcattttacgccgcaatctggtatgatagattaaaaaatatggagttttgaacatgaaagtatttatactgttttatctatggattgtcccgctcgtcatcgggctgatatttttccgggttacccagcggacaagttttaaaaaaaggttttatccaggctacatcatgatcgttcttgctgcggctgtatttgccgtctgctacttgatcggacagccttacctcgggaatttcttcggcggtacgatgctgttcggcaccctgctgccgtttatggctgccgcaatgaagaaaaagaaataacgaatctcaaaaaccccggcatgttttgggcttagaaagaccagcttatataaaagctggtcttttttcttttccctaaggttttatgacagctaaaagtggaaataataaaggacgaagagcaattagttgaaaaaaaaacgaaaaccacttatagtaaagttaaagtcaaatatagtcaaagtcaagtgaaggagggggctgagtggggaaaaatatttctgacataatcgaacagtatttgaaacaaatattagaacagaacgggaaagaaatattagagattaaacggagcgaaatagccgataaatttcagtgtgttccttctcagatcaattacgtaatcaatacgcgttttacgagcgagcgcggatatattgtcgaaagcaaaagaggcggcggcggttatatccgaattattaaaattaaaatgaacgacaaaattgatttgattaacaatattatgaatcaaatctatacaaggctctcccaggctgcttcagatgacatcattttaaggctgttagaaaatggtgtcattacagaaagcgaagcgaaattgatggtgagtgtcatggaccgttctgttttatatattgatttgcctgaacgagacgaattaagagcaagaatgatgaaagccatgcttacgtcacttaaatttaagtaaagcgggtgagaagcgtgatatgtcaagagtgtaaagaaagaccggcaacttttcactttacgaaagttattaatggtgaaaaaaaagaaatgcacatctgtgaacaatgtgcgaaagagaacagcgagtcatattctatgaatgaaagtggcggattttccatccataatttattatccggactgcttaattttgactcgtcttttacaaacagcagcgaggcgcagctttttcaacagccggatcaggttttgcgatgcaaaaaatgcaatatgacgttcccggaatttcgaaaaaccggccggtttggatgttcggaatgttataaaaccttccactcctatatcactccggttttaagaaaagttcacagcgggaacacggtccacgcgggtaaaataccaaagcggatcggcggtaatctgcatgtaagaagacaaattgaagcattaaaaaaagagctgaaagaattaattcagcaggaggaatttgaaaaagcagccaacatcagagatcagatcagatcgcttgaacaaaacctgaatgcaaacaaggaggaggaggactgatgtcactgcagcattttattcagaatgctttaagcaattggatgcggcaagaaggccctgagagtgacatcgtgcttagcagccggatccgtcttgcgcgcaatttggataaagtccgttttccaacgcttttttcaaatgaagaggcttcagcgattatagcattgtttgaagaacagttcacaggctatgaagtgcccggtatcgggaagtttgagcttgtgaaaatggatcaggtccagcctttggaaaaaagggttcttgtggaaaaacatctgatcagtccgcatttgacggaagcttcctttggcgcatgccttctttctgaaaatgaagaagtgagtattatgctgaatgaggaagatcatattcgcattcaatgtctatttccgggatttcagctgtcagaagcattgaaagcagcaaatcaggtggacgattggattgaagaccggatcgactacgctttttccgaacaaagaggctacttgaccagctgccctacaaatgtcggaacagggcttagagcttctgtcatgatgcaccttcctgctttagtgttaactaggcaaataaacagaattattccggcaattaatcaattagggcttgttgttagaggaatttacggtgaaggcagcgaagcattagggaatatctttcaaatttccaaccaaattaccctcggtaaatcggaacacgacattgtcgaagatctgaacagtgtcgttgcccagctgatcgaacaagagcgttcagcaagaaaggcgctttatcagacttcgcaaatcgaacttgaagaccgcgtctacagatcttacggcgtactgtccaattgccggatgatcgagtcgaaagaaacagcaagatgtctttcagacgttcgtcttggaattgacctggggataataaaaggtctttccagcaatatacttaatgagctgatgatcctgacacagcctggatttctccagcaatattccggaggagccttaaggccaaacgagagggacatcaggcgggctgctcttatcagggagcgcttgaaattagaaaacaacggcaatagacaggaggatgaaacgatatgatgtttggaagattcacagaaagagcacaaaaagtattggcgcttgctcaagaagaagctctgcgtctgggccataataacattggaacagaacatattctcctcggccttgtccgcgagggagaaggaattgctgcgaaagcgctgcaggcgttaggactcagccctgacaagattcaaaaagaagttgaaagcctcatcggccgcggacaagaaatgtcacaatcgatccattacacaccgagagccaagaaagtgaccgaattggcgatggatgaagcgagaaagcttggccactcctacgttggaactgaacacatcctccttggcttaatccgcgaaggggaaggtgttgcggcaagggtgctgaataatttaggcgtcagcttaaacaaagcgagacagcaagtattgcagctgttgggcagcaatgagagcggaggcgctgcttcaggcgccaacagtagcgccaacacaccaactttagacagtcttgcccgggatctcacggcgattgcaaaagaagacagccttgatcccgtgatcggcagaagcaaagaaattcaacgcgtgattgaagtgttgagccgcagaacgaaaaataaccctgtgttaatcggggagcctggtgtcggtaagactgcgattgccgaaggcctggcccagcagatcatcaataacgaagtaccggagattttacgcgacaagcgcgtcatgacacttgatatgggaacggttgtcgccggcacgaaatatcgcggtgaatttgaagaccgcctgaaaaaagtgatggacgaaattcgtcaagcgggaaatatcatcctcttcatcgatgagctgcatactctcatcggagccggaggagcggaaggggccatcgatgcctccaatatccttaaaccgtcgctggcgcgcggagagctgcaatgcatcggggcgacaacccttgatgaataccgcaaatacattgaaaaagatgctgcactagaacggcgttttcagccgattcaggttgaccagccgtctcctgaagaaagcattcaaatattgaaagggctcagagaccgctatgaagcccatcaccgcgtatcgattacggatgaagcgatcgaagcggcagtaaagctgtcagaccgctacatttcggaccgttttctgcctgacaaggcgatcgacttaatcgatgaagccggctcaaaggttagactgcgttcattcacaacgcctcctaacttaaaagagcttgaacaaaagcttgatgaggtaaggaaagaaaaagatgccgctgttcaaagccaggaattcgaaaaagcagcgtctttacgtgatacggagcagcgcttgcgtgaacaggtcgaagaaaccaagaaaacctggaaagaaaagcaaggtcaagaaaattccgaagtgaccgtcgacgatattgcaatggttgtatcaagctggaccggagtgccggtttccaaaattgcgcagaccgaaacagacaaattgctgaacatggagagcattcttcattcccgcgttatcggccaggatgaggctgtcgttgcagttgcaaaagcagtcagacgcgcgcgtgccggcttaaaagatccaaaacgtcctatcggttcgtttattttccttggcccaacaggcgtagggaaaacggagcttgcccgtgcacttgccgagtccattttcggcgatgaagaagcaatgattcgcatcgatatgtccgagtacatggaaaaacattcaacatcaagactcgtcggttcacctcctggatatgtcggctatgatgaaggcggacagctcactgaaaaagtgagaagaaaaccgtattccgtcgtcttgcttgatgaaatcgagaaagctcacccagatgtcttcaatattttgctgcaggtgcttgaagacggccgtctgactgattcaaaagggcgcacggttgactttaggaatacgattttgatcatgacatcaaacgtcggtgcgagcgaactgagaagaaataaatacgtcgggtttaatgtgcaggatgaaacccagaattataaagatatgaaagacaaagtcatgggtgaactaaaacgcgcctttagacctgaatttatcaaccggattgatgagatcatcgtcttccactctttggagaaaaaacatttgaaagatattgtatccctcatgtcagaccaattgaccaagcgtctgaaagaacaggatctttcaattgagctgactgaagcggctaaagaaaaaatcgccgatgaaggcgtggatctcgaatacggagcgcgccctctcagaagagcaatccaaaaacacgtggaagaccggctgtcagaagagctcctaaaaggccatattcaaaaaggccagcatattgttttggatgtagaagacggagaatttgtcgtaaaaaccgaagctaaaacgaactaatatagagacaaaagaaagaggcatacgatgttcatcagtatgcctcactttcttataaagggagcgttttgaaaaatcaatggctaaaacaaagactaaattcatttgtcactcatgcggctacgaatccgccaagtggatggggaaatgccccggatgcggtgcatggaataccatggtggaagaaacgataaaaaaacccgccgccaacagaagaaccgctttttcacattccgttcaaacagtgcaaaagccttcacctctcacttcaattgaaacaacagaagagccgcgaattaaaacgaaacttggcgaattcaaccgcgtcttgggaaacggcatcgtcaaaggttcacttgttttaatcggaggcgaccccggcatcgggaaatcaaccttgctgcttcaagtatctgcccagctcgctgattcaaaagaaaatgtcctgtacatctcaggcgaagaatcggtcaagcagacaaagctgagagcagaccgtctaggtatcaacagtcccactcttcacgttttatctgaaaccgatatggagtatattacgtcttctatagaagagatgaacccatcattcgtagtggttgattcgattcaaaccgtttaccaaagtgatatcacatccgctccgggcagcgtctcccaggtcagggaatgcaccgctgagctgatgagaattgcaaaaacgaaagggattccaatatttatcgtcgggcatgtcacaaaagaaggttcgattgccggaccgagacttctggaacatatggtcgacaccgtcctttactttgaaggtgagcggcatcatacatttcggattttaagagccgtcaaaaaccggtttggatcaacgaatgaaatgggaatctttgaaatgagggaagagggcctgacagaggtgctgaatccgtcagaaatctttctcgaagagcgctcggcgggagcggccggatcgagtgtcgtggcctcaatggaaggcacgaggccagtcttagtagagattcaggcgctgatttcccccacgagctttgggaatccgcgccggatggcaaccgggattgatcataaccgcgtctcattgctaatggcagttttagaaaaaagggttggactgctgctgcaaaatcaagacgcctatttaaaagtcgccggaggcgtcaagctggacgagccagcgattgacctcgccgttgcagtgagcatcgcctcaagcttcagagacaccccgcctcatccgacggattgttttatcggagaagtcggattgacaggggaggtccgcagagtatcaaggatagaacagagggtgcaggaagcggcgaagcttggttttaaaagaatgattattccttctgcaaatgtagaaggatggacaaagccgaaaggaatcgaagtcgtcggcgttgaaaatgtagctgaggcccttcgagcttcattaggaggatcataatatatggacaaagacaaaaaaggagcgaaacaggatctttcagaaatattgcagtttgtcgcccccggcacgcctcttcgcgaaggaatcgaaaacgtccttcgggccaaaacaggcggattaatcgtggtcggcttcaacgataaagtgaaagaagtggttgacggagggttccacataaattcttctttctctccggctcatctgtacgagctggctaaaatggacggggcgatcattctcagcgattcagggcaaaaaattctatatgccaatacacagctcatgcctgaggcgacgattccctcctctgagacgggcatgagacacagaacagccgagcgtgtggccaagcagaccggctgtctgatcatcgcgatttctgaaagacggaatgtgattacgctctatcaggaaaatatgaaatatatactcaaagatatcggctttatcttaacaaaagccaatcaggcgattcagacgctcgaaaaatacaaactcattttggaccatgcgatttccaatttgaacgcgctggaatttgaagagcttgttacatttggggatgtcatctccgttctgcatcgatatgaaatggtgctcagaatcaaaaacgaaattaatatgtatattaaagagcttggaacagaaggccatctcatcagactccaggttagcgaactgatcaccgatatggagcaggaagcggcgctgttcgtcaaagattatgtgaaagaaaaaatcaaagacccgtttgttctgctgaaacagcttcaggatatgtcgagtttcgaattgctggatgatgcgattctccttaagcttttaggctattcagcaactacgaacatggaagaatacgtttttccgagaggctacaggcttctccacaaaattccccgcctcccgatgccgatcgtcgaaaatgttgtcgaagcattcggccatttaaagctcattatcgaagcggatgtaaaagatttggatgaagtggaaggaattggggctgttcgtgcccaaaagataaagaaagggttaaagagacttcaggagaaacattatactgacaggcagctgtgagaaaattttctagaagtgattaaaatttgcaatttatgggtatattattcttactttttgttttccctttttcacgtggaaacagctgcatttataaaaattaaaacgattattttaaaggaggtgaaggtatgttaaaacgaatagttcaagcgttctttgcgattttgggaggcgttatcggtatttttctcataccggaattgtttgtactgttaaatgtacaggacatacctttagtaacaaacccgtatgcgtccgcttgtttaggagctatcatcttttttcttctgggcatctggtgtgcggatcacgtcatcaactgggtgaaacagattgaggattccttgatcaaagcacctgtctcagacttgttgttcggctctttgggattaatcttcggacttatgctcgcttatcttatcgtcaacgtcattccgttaaaagacatcccttatcagttaatcagcacggtcattccgattgtgttggccgcatttctcggctatctcggattccgtgtgggtttcaagaaaaaggatgaaatgctgacactttttgcatcgagaaagaaaaaaggttctgctgaggaagagcgtccggaagaagacaaaaagctgaaaattttagacacaagtgttattatagatgggagaattgctgatatttgtcagaccggatttcttgaaggcgtcattgtgattcctcagtttgtgcttgaggaactgcagcatatcgccgactcttcagacgtcctcaaacgaaacagagggcggagaggactggatattttaaaccgtatccagaaagagcttgatattaaagttgaaatttatgaaggcgattttgaagacatccaagaggtcgacagcaagctcgtcaaactggcgaagctgacctcgggcgttgtcgtcacaaacgatttcaatttgaacaaagtatgcgagctccaaaaggttgccgtattgaacatcaacgaccttgccaacgccgtcaagcctgtcgtgcttccgggagaagaaatgaaggtgcaggtcatcaaagacggaaaagaacataatcagggcgtggcttatctggacgacggcacgatgattgtcgttgaagaagggcgaaattatattggcaaacatatcgacgtgctcgtgaccagcgtgctgcagacagcggcaggcagaatgatattcgccaagccgaaactgctggaaaaggcgctttgaaaaagggagaaataaaatgaattatgaagtcgtcattcctgccgccggacaaggtaaacgaatgaatgccgggaaaaacaaactgtttatcgaggcgaaaggaatacctgtgattattcatacattaaaggtgtttgaaaaccatgatgcctgcaaaaggatcattcttgtcatcaatgaacaggaattcggtgaattcaacacccttttaaaaacctatcattttacgactccgatcgagatggtgccgggcggaagagaacgccagcaaagcgtttttgcgggcattaaagcggccggcaaagaggaaacggtcctcgtccatgacggagcaagaccttttattaaacgggaatatatcgaacagcttgtcgagaaagcaaaggaaacaggggcagccatcgttgccgttcctgttaaagacacgatcaaacgcgttcaagacggtgagatagccggaacgattgaacgttcaagcttgtgggccgctcaaaccccacaagcttttcgtctttctattctgatgaatgctcaccttgaggctgaagcaaaaggtttcctcggtacggacgacgccagtcttgtcgaggaagccggaggtacggttgcaatcattcaaggggattatcaaaacatcaaactgacgaccccggatgacttgcttgtcgcagaagcgatattagaagcggaaaagaggaatgaacatgtttagaataggccaaggatttgacgtccatcaactagtggaaggcaggccgctcataatcgggggaattacgattccttacgaaaaaggccttctcggacattcagatgcagatgtgcttttgcacacgattgcggatgcatgtctcggtgccgtcggcgagggcgatatcggaaaacactttccggataccgatcctgaattcaaagatgccgactccttcaaactccttcgccacgtctggatgatcgtgaaggaaaaaggctatacgctagggaacctggattgtacaatcatcgcccaaaagcctaaaatggcgccgtatatcgaagacatgagagccagaattgccgaagggctagaggcggaaatttcccaaattaacgtaaaagcgaccacaaccgaaaagctcggatttacgggaagagccgaaggaatcgccgcccaggcttccgttctgctccaaaaggtataattcattttgaagacaggttcatttgatgatagaataggaaataaatttgaactctgctagagacgaaaggaagttagacagatgggaaacgaagttcgggttcgttatgcgccgagcccaacaggccatttacatatcggaaatgccagaaccgctctttttaattatttgtttgcccggagccaaggcggaaaattcatcatccgcattgaagatacggaccgcaagcgcaacattgaaggcggggagcaaagccagctgaactatttaaaatggctgggcatcgactgggatgaaagcgtggatgtcggaggagaatacggaccataccgccaatccgaaagaaacgacatttacaaaacatattacgaggagcttcttgaaaaagggctagcctacaaatgctactgcacggaagaagagcttgagaaagagcgtgaggaacaggctgcccgcggaggaatgccgcgctactccggcaagtgccgcaatttaacaaaagaagagcaggaaaagctcgaagctgaaggaagacagccgagcatccgctttaaagtgcctcaaggtgaagtcatccgctttgatgacatcgtcaaaggagaaatttcttttgaaacagacggaatcggcgacttcgtcatcgtgaagaaagacggaacgcctacttacaactttgccgtagcggtcgatgactatttaatgaaaatgacgcatgtcctgcgcggcgaagaccacatttccaatacgccaaagcagatcatgatttacaacgcccttggctgggatatcccggcatttggacatatgacattaatcgtcaatgaaagccgcaaaaaactgagcaaacgtgatgagtccatcattcagtttatcgagcagtacgaagagctcggctatttgccggaagcattgtttaacttcatcactcttctaggctggtcgccggtcggagaagaagaactgtttacaaaagaacagtttattgagatatttgatgtaaaccgtttgtcaaaatcaccagcggtgtttgatacgcataaactgaaatgggtcaacaaccagtatgtgaaaaaacttgatcttgatcaggtcatcgaattgaccgtgccgcatttgcaaaaagcgggcaaggtttcagaagagctttcaggcagcgaacaggaatgggtgcgcaagctgatttccctatatcaggaacagctgagctacggcgctgaaatcgtcgagttaacagagttgttctttaaagacgatatccagtataatcgtgaagcaagaacagttttagaagaagagcaggttccggaagtgcttcgcgtatttgccgaaaagcttgagcagcttgactcgtttacggcagatgagatcaaggcatccatcaaagccgttcaaaaagaaacaggacataaagggaaaaagctgtttatgccgatccgcgtagcgacgacaggccagacccacggtcctgaactgcctcagtccattgaattattggggaaagacaccgttttaaaacggctgcataacattattcaataagataaatcgttgacagggataagtataaagccagggcctttaaagagagagtcttcatcggctggaaaagacttaagcgccgggctttagaaatgcacctcttgagacctttgaagaacgtttttataacaagtattcaaaggcggtatccgccgttatggatgagagttgagaaaacagctgtgctgttttctaaacagagtggaaccgcgcgtcaaaaagcgtctctgtcatcagacagaggcgttttttatatggtttgacaatagagacaaaggaagcggggaacggggggaatcatgtgttctttaaaatgctgaaagaagatgtagatgtcgtatttgaccaagatccggctgcgagaagctacattgaagtcatcttaacttattcaggtttgcatgctatatgggcacatcgaattgcacatgctttatataaaagaaaaaggtttttcatcgccagagcgatctctcaaatcgcccgcttctttacgggaatcgaaattcacccgggtgccaagatcggcaggagatttttcattgatcacggcatgggggttgtgatcggcgaaacctgtgagatcggaaacaatgtcacggtttttcagggcgtgacgcttgggggaacaggaaaagaaaaaggcaaaaggcatccgacaatcgaggacgatgccctgatctcaacaggggccaaagtgcttggatccattacagtcggaagaggggcgaaaatcggtgcaggctccgtcgtcctgcacgatgtgcctgaatgctccaccgttgtcggcatcccgggccgggtcgtcgtacaaaacggaaagaaaatcagacgcgacttgaatcaccaggatttgccggatccggtggctgaccgcttcagagaattggaaaacgaaatcaggcagctgaaacaagagctccggagaaaagaaagggaagatgagctgtgacactaacattgtataatactctcacacgaaaaaaagagccgtttgtgcctcttgaagaaggcaaggtcaaaatgtatgtgtgcggtccgacagtatataactacatccatatcggaaacgcaaggccggctatcgtgtttgacactgtcagaaagtatttagagtataaaggctatgaagtccaatatgtctccaattttacagatgtcgatgacaaattaattaaagcggcaaatgaacatggagaggaagtgccggtcatcgccgaacgctttattaaggcatacttcgaagatgtcggttcactgggctgcacaaaagctgactgccatccgcgcgtcactgaaaacatggatgagatcatcgactttattcagacgctgatcgataagggctatgcctatgaggcggacggagatgtttattataaaacaagatcgtttgaaggctatggaaagctgtcgcatcaatcggtcgatgagctgagatcaggcgcccgaattcaagtgggcgaaaagaaagaagatgcgctcgatttcacactatggaaagcggctaaagataacgaaatctcctgggatagcccttggggaaaaggccgtcccggctggcatatcgagtgctctgcgatggcgagaaaatatctgggcgattcgatcgacattcacgccggcggtcaggatctggccttcccgcatcatgaaaacgaaattgcccaatcggaagcattaacagggaagcctttcgcgaaatattggcttcataacggctacattaatatcgataatgagaaaatgtcaaaatcgctcggcaactttgttcttgtgcatgacattattaaagagcatgacccccaagtgctgcggtttttcatgctgtctgttcattacagacatccgataaactattcggtcgaacttctcgagaacacaaaaaacgcttttggacgtctaaaaacagcttatagcaatttgcagcatcgcctaaaaagcagtacaaatttaacagagggcgattcagaatggcttgaaaaaatcgaagagcagcgaaaagccttccaaacggctatggatgatgatttcaatacagcgaatgccatttccgtcctgtttgacctggccaaacatgccaactactatttgcaggaaaagaatactgcagaacatgtcattcaggcgtttatacagctgtttgacgagatctgctcagtgctcggcttctccctcaaggaacaggaacttttggataaagacattgaagaactgatcgagaagcggaatgaggcccggagaaaccgcgactttgcaacatctgatcagattcgcgaccagttgaaaagcatgaatattatcttggaggacactccgcagggcacgcgctggaaaagaggagaatcataaacatgaatttggaaaccattaaagacgccaaacagctgaatggtttggcgcttgcttacatgggtgatgccgttttggaggtatatgtgaggcatcacctcttaaagcaaggcatgacaaggcccaatgatctgcaccggcagtcgaggcgatatgtctccgccaagtcgcaggcaagcatgctgtttgcgcttgaggagcaggaatttttcaccgaggaagaacaggctgtgctgagaagagggcggaatgccaaatccggaacggtaccgaaaaacacggatgtccaaacatatcgttacagtacggcttttgaggcggtcatcgggtatctttttcttgagaacagggaagataggcttaatgaactcatcaaagcagcgctggaaaaacgggatggcagggaggaagtaaaatgagtcagcagcatgattacgtcataggaaaaaacgcggtcatcgaaacattaaagtccggccgggaattgtataagctgtggatggcggaaaacacagtgaagggacaggctcagcaagtcgtcgatctcgccgccaaaaaaggcgtcacgattcattatgtcccaagaaaaaaactcgatcaaatggtttccggacagcatcaaggcgtcgtcgcccaggtagcggcttacgagtatgccgagctggatgatctttttcaaaaggccgaagacagaaatgaacagccgtttatccttgtattagacgaaattgaggatccgcacaacctgggctctattatgcgcaccgcagacgcggtcggggctcacggcatcgtcattccgaaaaggcgcgcggtcggccttacaacgactgtcgccaaagcctcgacaggagccatcgaacatattccggtcgtcaaggtgaccaatctgtcgcggaccctggaagaaatgaagggacggggcatttgggtcgtcggtaccgatgcgtctggacaacaggactacaggtcgctggacggaaatatgccgcttgcgcttgtcatcggcagcgaaggaaaaggcatgggaaggcttgttaaagagaaatgtgattttctcattcgcctgccgatggcgggaaaggtcacatccctgaacgcctcagttgcagccggcctgctgatgtatgaagtgtaccggaaacgaagccctctgggagaatagacggaatggacatcctgttggtcgacggttataacatgattggggcttggcctcagctgaaagatttaaaagaaaacagttttgaagaagcaagggacctgttgattcagaagatggcggaatatcaatcgtatacagggtttcgggtaatcgttgtctttgatgcgcatctcgttaaaggaatcgagaaaaagaaggtcaatcatcgcgtagaagtgatattcacaagggaaaatgaaacggctgatgaacggatcgagaaactggtgtcagacttgaatagtattcagacgcagatccatgttgccacatccgattacacagagcagtgggcgatttttggccagggggccctgcgcaaatcggccagagagctgctcagggaggtcgaagcgatcgaaaggcaaattgaaaacagggtgaaacaaatcacctcagagcgtcccgcagggaaaattccattgtcagaagacgtcttgaggatcttcgaaaaatggcggcgtggcgacttggattaggttgacgcttttttgtccattactgtataatatttctatctacgtgcggtcggggggatcggagtgaacttacaaaacaaccagggaaaattcagcaaagaacagttcagcaaagaacgtttttgccagttggaagacgagcaggtcattgaaatggttcatgtcggagacagtgatgcgttagattacttgattacaaagtaccgtaattttgtaagggcaaaagcaagatcctacttcttaatcggggctgatcgggaagatatcgttcaggaaggcatgattggactctacaaatctatccgtgattttagagaggacaagctgacttcattcaaagcttttgcagaattatgcattacccgccaaattattaccgctatcaaaacagctactcgccagaaacatattccgctcaattcttatgtgtcgctggacaagcccatttatgacgaggaatcagaccggacgcttctcgacgtgatttcaggggccaaggtcatgaatcctgaagagctgatcatcaatcaggaagaattcgatgatatcgagctgaaaatgggagaattgcttagtgatttagaaagaaaagttcttgcgctctatctcgacggaagatcctatcaggaaatatccgaagaattaaaccgccatgtaaaatcgatcgataatgcgctccagcgtgtcaaaaggaagcttgaaaagtacctggagctccgcgaaatcagcttgtagccgatgcttatggcatattgacagtcattttatgactgtgatatgttacttaggaaatgaacgtccagaaaaaggtgtaaacatgaagaaaaaagtaacgttagcctgcaaaaattgcggaaatcgtaattatacgacaatgaaaagctccgcagctttggctgaacggctcgaagtaaagaaatactgcaataactgcaattcacatacagtacatctggaaacaaaatagatgtttttgtttttaggttgtggaggtttcttaccatgggtattatcaaatttttaaagaatgtcggaaaagaaatgaaaaaggtcacctggcctaaaggaaaagaactaacgcgctatacgatcactgttatcaccaccgttatctttttcgccatcttttttgcactcatcgattcgggtattacgcaattaattcgtttaatagttgaataatgatcagcataacgtgttataatagatctaaatatgacttgccaaaaaacccgttcaacgggttttttcattgtttcaaaatatgaggctcgtataaaagaaagtgtcagtttcccggtacggccaataaacttttaaggtgtggggagggaaggactgaaagggtcctgaatgagaatggaaaagaaatggtatgtggttcatacgtactccggctatgaaaataaagtaaaggcgaatttggaaaagcgggtagaatcgatggggatgcaagataagatattccgcgtcgttgtacctgaagaggaagaaaccgatattaaaaacggcaagaaaaaagtcgttaaaaagaaagtcttccctggttatgtacttgtcgaacttgtcatgacggatgattcctggtatgttgttcgaaatacgcctggtgtgaccgggtttgtcggttcagccggatcaggttcaaagccgactgcactgcttccgggcgaagcggaaaaaatcctgaagcggatggggcttgaagaaagaaaaacagaaatcgactttgaattaaaagaaaccgtcaaggttatcgacggcccgtttgctgatttcacagggacgatcgaagagatcgaccacgacaaaaataaagtcaaagtttttgttaatatgttcggaagagagaccccggttgagctcgaatttactcaagttgacaaattgtaatggaaaagcgcttgaaatcactatataaaagtggtaatatacaaaggtgcgtcttggcaaaaaggtcaaggcagctagcttgatattttcatcattcatataaagaatgagaccttgagtgggagggttcaccctattaccacatcacggacttaaggaggtgtgtctcgtggctaaaaaagtagttaaagttgtaaaattgcaaattcctgctggaaaagcgaatccagctccgccagttggtcctgcgttaggtcaagccggtgttaacatcatgggattctgtaaggagtttaacgctcgtacatctgaccaagctggtctgatcattcctgtagaaatttcggtttacgaagaccgttcatttacatttatcacaaaaactccgcctgctgctgtattgcttaaaaaagcggctggaattgagtcaggttctggtgagcctaaccgtaataaagtcgcaaccgttaaacgcgataaagtacgtgaaatcgccgaaacaaaaatgcctgacttaaatgcggcagatgttgaagcggctatgcgtatggttgaaggaactgcccgcagtatgggtattgtgatcgaagactaatttttgtctctttgctgggttgcgagtttggatcagacaagttcgcaacccttattcgtgggaggttattccgctaaaaccactaaggaggaaattttaaaatggctaaaaaaggtaaaaaatacgtcgaagctgccaagcttgtagatcgtacaaaagcttacgacgtaaacgaagcgattgagcttgtgaaaaaaacaaacacagctaaattcgatgctactgttgaagcggcatttcgtttaggtgttgaccctcgtaaaaacgaccagcaaatccgcggtgcagttgtacttccaaacggaacaggcaaaactcagcgcgttcttgttttcgctaaaggtgaaaaagcgaaagaagcagaagctgctggtgcagactacgtaggcgatgcagattacatcaacaaaattcagcaaggctggtttgattttgatgtgatcgttgcgactcctgacatgatgggtgaagtcggtaaaatcggacgcgtgcttggaccaaaaggtcttatgccaaaccctaaaacaggaacggttacatttgaagttgaaaaagcagtcaacgaaatcaaagcgggtaaagttgaataccgcgttgataaagcaggaaacatccacgttccaatcggaaaagtgtctttcgaagaaggcaagcttgtagagaacttcgcgacaatgtacgacacaattttgaaagcgaagcctgctgctgctaaaggtgtatacgtgaaaaacgtttctgttacatctacaatgggacctggaatcaaagtggacccttcaactttcaacgtaaaataatattgacttttgataagacgttctgatataattcaaaacgttgtaaaaataaaatatgtccatttataccgtagacagtaggtgctgataaggcttaatttcctaccgaggtgtatatatatcacagctctagcgttacgtatgcttgtatatacagcctccatgtcgaatggaggctttttatatggaacatgtcgttaaagaacgtgatcaccgaacggtataagtgttacacagatgaatcttacaggaggtgtaaccatgagcagcgcaattgaaacaaaaaaagttgttgttgaagaaattacttctaaactgaaagaaagtaaatcaacgatcatcgttgactatcgcggccttaacgtagctgaagtaacagaacttcgtaaacagcttcgcgaagctaacgttgagttcaaagtgtacaaaaacacgatgactcgccgtgcggttgaacaagctgaacttgatggtttgaacgatttcttaacaggaccgaatgcgattgcattcagcactgaagatgttgtcgctccagctaaagttcttaacgagtttgctaaaaagcacgaagctcttgaaatcaaagcgggcgtaatcgaaggcaaagtgtccacagttgaagaagtgaaagctcttgctgaacttccatctcgcgaaggcttgctttctatgttgcttagcgtacttcaagctccagttcgcaatcttgctcttgcaactaaagctgttgcagaacaaaaggaagaacaaggcgcttaatagcatcagtatctaaaaaataaaacaaaatggaggaattacaaatggctttaaatatcgaagaaatcattgcttccgttaaagaagcaactgtacttgaactgaacgacttagtaaaagcaatcgaagaagaattcggcgtaactgctgctgctcctgtagctgtagctggcggagctgctgcaggcggtgctgctgaagaaaaaactgaatttgatcttgttcttgctggtgcaggagatcaaaaaatcaaagttatcaaagttgttcgtgaaatcactggtcttggcttgaaagaagctaaagaacttgttgacaacactccaaaacctcttaaagaaggtattgcgaaagaagaagctgaagagcttaaagctaaacttgaagaagttggcgcttctgtagaagttaagtaatcttcacctaatctttaggggaaagctcgcttttaaaagcgggctttttctttgctaattaattgtagtcccttccgcataagataagccatcttgtttcaagatatctggagagttcaccaactgaggaggttctgtgatgactgaccattattattcggaaaaaccttcagcaaaaagcagcagatcaatgtgggcatttcgcttgagaaaccggacgtttacttttatcagcgacagcggagttttttcaaaaagagaagtggactttggctcaaggctgctgattgaagctttccgggaaccggatgcagaaggtgattttttggatgtaggctgcggctatggcccgattggtctttcgcttgctgcggatttcgaagatcgaatggttcacatgatcgatgttaatgaaagagctgtcgaactttcgaaggaaaacgcgttaaataatcagatcgacaacataaagatctaccagagtgatctgtttgccaacgtcgaacctgcaaaaaaattcgcttctattattactaatccccccatacgcgccgggaaaaaaactgtgcacgccatctttgaaaaaagcgctgaacatttgcggccttcaggagagctgtgggtcgtcattcagaaaaaacaaggcgggccttctgccattgaaaaattaaaagaactttttgcggacgttgaagtcgttcaaaaaaagaaagggtactatatcatcaaagcaaaaaaagtttgactcggattttcagctatgttaacattataaaatgccaatgtatatattttgctgccgtttttaagaaacgcctaggtttgtataaaatatacattattgggaacactaataaaatcggtattttgtttttggatgtggttttctaaattagaaacccttttttcttttgtcttgtaaaagtatttcttacatatttgaggaagaaatgcttgttacacatatattacgcatgatttgaggggtgaatcagttgacaggtcaactagttcagtatggacgacaccgccagcgcagaagctatgcacgcattagcgaagtgttagaattaccaaatctcattgaaattcaaacctcttcttatcagtggtttcttgatgagggtcttagagagatgtttcaagacatatcgccaattgaggatttcactggtaacctctctctggaatttatcgactacagcttgggcgagcctaagtatccggtagaagaatcaaaagagcgggatgtgacctattcagctccgctgcgggttaaagtccgcttaatcaacaaagaaaccggcgaagtaaaggatcaggatgtcttcatgggcgatttccctattatgacagacactggaaccttcattatcaacggtgcagaacgggtcatcgtatctcagctcgttcgttctccaagtgtatattttagtggtaaagtagacaaaaacggtaagaaaggttttaccgcgactgtcattccaaaccgtggcgcatggttagaatacgagactgatgcgaaagatgttgtttacgtacgcatcgatcgcacacgtaagttgccggttacggttcttttgcgtgctcttggcttcggatctgaccaagagatcattgatctcatcggtgaaaacgagtatctgcgcaatacgcttgataaagataatacggaaaacaccgataaagcgcttcttgaaatctacgagcgtcttcgtccaggggagccgcctaccgtagaaaacgcaaaaagcctgcttgattcaaggttctttgatccgaaaagatatgaccttgcgagtgtaggacgttataaaattaataaaaagcttcacatcaaaaaccgactttttaatcagcggcttgctgaaacgctagtcgaccctgaaacaggcgaaatccttgccgaaaaaggagcgattttagacagaagaacgcttgataaagttctgccgtaccttgaaaacggaatcggttttaaaaagctttatccgaacggcggagttgtcgaagacgaagtaacgcttcagtctatcaaaatctatgctccgacagaccaagaaggggagcagacaatcaatgtgattggaaatgcttatatcgaagaaggcgttaagaatattacaccttctgatattatcgcttccatcagctatttctttaacctgcttcacggagtgggcgataccgacgatatcgaccatctaggaaaccgccgtctccgttcagtgggagagcttctgcaaaaccaattccgtattggtttaagcagaatggagcgcgttgttcgtgaaagaatgtctattcaagatacaaacacgatcacgccgcagcagctgatcaatattcgccctgtcatcgcatcaatcaaagagtttttcggaagctcgcagctttctcagtttatggatcagacgaatccgcttgctgagctgacgcataagcgccgtctgtcagcgctcggaccgggcggtttgactcgtgagcgcgccggaatggaagtccgtgacgttcactattcacactacggccggatgtgtccgattgaaacccctgagggtccaaacatcggcttgatcaactcgctttcttcattcgcgaaagtgaaccgtttcggcttcatcgaaacgccgtatcgccgcgtcgatcctgaaactggaaaagtaacgccgagaatcgattacttgacagctgatgaagaagacaactatgtcgttgcccaggcaaacgcacgcctgaatgatgacggttcttttgtggatgacagcatcgtcgcccgtttcagaggggagaacaccgttgttccgaaagaccgcgtcgactatatggacgtttcgcctaaacaggttgtctctgccgcgactgcatgtattcctttcttggaaaacgatgactcaaaccgcgcccttatgggagcgaacatgcaacgtcaggccgtacctcttatgcagcctgaatcgccgatcgtcggaaccgggatggaatatgtatctgcgaaagactccggtgccgctgttatttgccgccaccctggaatcgttgaacgggtggaagcgaagaacatctgggtgcgccgctatgaagaagtcgacggccagaaagtcaaagggaaccttgataaatacagcctgctgaagtttgtccgttccaaccagggaacttgctacaaccagcgtccgatcgtaagcgtcggtgatgaggttgaaaaaggtgaaattttagctgacggtccgtccatggaaaaaggtgagcttgcccttggacgcaacgtcatggtcggctttatgacatgggatggctacaactatgaggatgccatcatcatgagcgaacgccttgtaaaagacgacgtatacacgtctattcatattgaagaatacgaatcagaggcccgggatacaaaactcggacctgaagaaatcactcgcgatattccgaacgtcggtgaggacgctcttcgcaatctcgatgaacgcggaattatccgtgtcggtgctgaagtaaaagacggagatcttcttgttggtaaagtaacccctaaaggtgttacagagcttacggcggaagaacgcctgcttcatgccatcttcggggaaaaagcgcgtgaagtgcgtgatacgtcgctgcgtgtacctcacggaggcggcggtatcatccatgatgtaaaagtgttcaaccgcgaagacggagacgaactgcctccgggcgttaaccagctcgtccgcgtctacatcgttcagaagcgtaaaatttctgaaggggacaaaatggccggacgccacggtaacaaaggtgttatttcgaaaattcttccggaggaagatatgccgtatctgcctgacggaacgccgattgacatcatgttaaacccgctgggcgtaccatcgcgtatgaacatcgggcaggtgttggagctgcaccttggtatggctgcacgccgcctcggtctgcatgtcgcgtcacctgtatttgacggtgcccgcgaagaagatgtgtgggaaacccttgaagaagccggcatgtcaagagacgcaaaaaccgtcctttacgacggccgaactggggagccgtttgacaaccgggtttctgtcggcatcatgtacatgatcaaactggcacacatggttgacgacaaattgcacgcacgttcaaccggtccttactcactcgttacccagcagcctctcggaggtaaagcgcagttcggcggacagcgttttggagagatggaagtttgggcgcttgaagcttatggtgcagcatatacgctacaagagatcctgactgttaaatcggatgatgtcgtaggccgtgtgaaaacatatgaagccatcgtaaaaggcgacaatgttccagaacctggtgttccggaatcgttcaaagtattgatcaaagagcttcaaagcttaggtatggacgtcaaaattctatcaagcgacgaagaagaaatcgaaatgagagacttggaagacgacgaagacgcgaaacaaaacgaagggctttctctgccgaatgatgaagagtccgaagagttggtttctgctgacgcagaacgcgatgtcgttacaaaagaataaacgaattttatacgcaagtgacagggtataacccgaagataaaaagggaggtaggccccttgctggatgtgaacaattttgagtatatgaacatcggtctcgcttcacctgacaaaatccgttcatggtcttacggagaagtgaaaaagcctgaaacaatcaactatcgtactttgaaacctgaaaaagatggtctattctgcgagcgcattttcggtcctcaaaaggactgggaatgccactgcggaaagtacaagcgggttcgttataaaggcgtagtctgcgaccgttgtggagttgaagtaacccgggctaaagtccgtcgtgagagaatggggcatatcgagctggcagccccggtttctcacatctggtattttaaaggaattccgagccgtatgggtcttgtgctggatatgtctccgcgcgcattggaagaagtcatttactttgcttcttacgtcgtaacagatccggccaatacaccgctcgagaaaaaacagcttctttctgaaaaagagtatcgggcgtacctcgataaatacggaaataaattccaagcgtcaatgggtgctgaagcgattcataagctccttcaagatatcgacctcgataaagaagtggatatgctgaaagaagagcttaaaacgtcacaaggacagcgccgcacacgtgcgatcaaacgtctggaagtattggaagccttccgcaattccggaaataagccgtcatggatgatcctcgacgttcttccggtcattccgcctgagctgcgaccaatggtacagcttgacggtggacgttttgcaacttccgatctgaacgatttgtatcgccgcgtaatcaaccgtaacaatcgtttaaaacgtcttctggaccttggagcgccaagcattatcgttcaaaacgaaaagcgcatgcttcaggaagccgtggacgcattgatcgataacggacgcagaggacgtcctgttacaggtccaggaaacagaccgttaaaatccctttctcacatgctgaaaggtaaacaaggccgtttccgtcaaaaccttctcggtaaacgtgttgactactcaggacgttcggttatcgtcgtaggtccgaacctgaaaatgtatcaatgcggtcttccgaaagaaatggcgctggaactgttcaagccattcgtcatgaaagagcttgttgaaaagggccttgcccacaatattaagagcgcgaagcgtaaaattgagcgcgttcagccggaagtctgggatgtccttgaatcagttatcaaagaacaccctgtgcttctcaaccgtgcacctacgcttcacagattaggtattcaagcgtttgaaccaacgcttgttgaaggccgtgccatccgtcttcatccgcttgtatgtacggcatacaacgctgactttgacggtgaccaaatggcggttcacgttcctttatcagcagaagcgcaagctgaggcgcgcatccttatgcttgctgcgcaaaacatcctgaaccctaaagacggaaaaccggttgttacaccgtctcaggatatggtacttggaaactactatctgacgctagaacgccctggtgcagtcggcgaaggtatgattttcaaagatacggatgaagcgctgcttgcttaccaaaacggatatgttcatttgcatacgagagtagccgtcgcggttaactcattgaaaaatgaaacgtttaccgaagaacagcgttccaagctgctcattacaactgtcggaaaactgatcttcaacgaaattcttccgccgtcgttcccatacatgaacgaaccgacgaagagcaacattgaagaaaaaacgcctgaccgtttcttcttggattacggtgcagatgttaaagaagccattaagaaccaagaaatcaacccgccgttcaaaaaaggcattttgggtaaaatcattgcggagatcttcaaaaggttccatattacagaaacatcaaaaatgcttgaccgcatgaaaaacctcggctttaaatactctacaaaagccggaattacggtcggtgtttccgatatcgtcgtattggacgacaaacaggaaatccttgaagaagcgcaaggaaaagtcgataacgtgatgaagcagttcagacgcggtctgattactgaagaagagcgttatgaacgggtcatttccatctggagtgcagctaaggatacgatccaaggcaagctgatgaaatccttggatgaaatcaacccgatctacatgatgagtgattccggagcccggggtaacgcatcaaactttacgcagcttgcgggtatgcgcggtctgatggccaacccggccggacggatcatcgaacttccgatcaagtcaagtttccgtgaaggtttaacggtactcgagtactttatctctactcacggtgcgcgtaaaggtcttgcggatacggcccttaagacagccgactcaggttacctgacacgccgtctcgtagacgtagcccaagacgtcatcattcgtgagactgactgcggcacagaccgaggcattcttgccaaagccatcacggaaggcacagaagtgatcgagcgtcttgaagagcgtcttgtcggccgattcgcgagaaagcctgttaaacatccggaaacaggtgaagtgctcgtgaatgaaaacgagctgatcgacgaagataaagcgattgaaattgtcgaagcaggcattgaagaagtgtggatccgctccgcatttacatgtaatacgtcacatggtgtatgtaaacgatgctacggccgcaacctggcaacaggaaccgatgtcgaagtcggagaagcagtcggaatcatcgctgcccagtccattggtgagccgggtacacagttaacgatgcgtaccttccatacgggcggggttgccggagacgatattacacaaggtttgccgcgtatccaggaattgtttgaagcgcgaaaccctaaaggtcaagcgacgatctctgaaattgacggtgtcgtggccgaaatcaatgaggttcgcgataaacagcaggaaatcgtcgttcagggcgaagtcgaaagccgttcatatacggcgccttacaacgcgcgcttgaaagtcactgaaggagagaagatttctcgtggtcaagtgctgacagaaggttcggttgatccgaaagagcttctgaaagtcactgacatcaccacggtccaagaatacctgcttcatgaagtgcagaaggtttatcgtatgcagggggttgaaatcggagataagcacgtcgaggttatggttcgccagatgcttcgcaaagtgcgcgtcatcgatgccggcgacacggaagtgctgccaggcacgctgctcgatattcaccagtttacagaagcaaacaaaaaagttctgcttgaaggcaaacgccctgcaactggccgtccggtgcttctcggtatcaccaaagcatcgcttgaaacggattccttcctgtctgccgcgtcattccaggaaacaacacgtgtcctgacagatgcagcgatcaaaggaaaacgtgacgagcttctcggcctgaaagagaatgttatcatcggtaagcttgttcctgctggaacgggtatgctgaactatcgtaaagtgaagccggtattgcaagtccaatcatctgatgaaatggttccggctgaataaataaaaaatcctaaagaaggatgtcactaaaaattgtcatcatatgttgacatccttctttcaggatgataatataaccaaggtgctcaatttaaacctgttactttggaggatatatgatgtcttatgataaagtatcacaggctcaatctattattatcggtacgaagcagacagtcaaagcactgaagcgcaattctgttaaggaagtcgtcgtagcaaaggacgctgatccttgtctgacgtcaggtgttatcaatctggcaaatgaacaaggggttccagtctcaatggcagagtccatgaaaaagctcggcaaagcctgcggaattgaagtcggagctgcagctgttgccattattcaataacgtactcgttgtttttgtttttatgcaaaggcattgttttttgcttttaaatgaaccacctgggtatgtgggttataaaacgtaatgaagggaggaaatacaaaatgcctacaattaatcagctagtccgcaaaggacgcgtaagcaaagttgaaacttctaagtctccagcacttaacaaaggatacaacagcttcaagaaagagcacactaacgtatcttcaccacaaaaacgcggagtatgtacccgtgttggtacaatgacaccgaagaagccgaactcagcgcttcgtaaatatgcccgtgttcgcttaactaacggaatcgaggttacagcctacattcctggtatcggacacaacctgcaagagcacagtgtcgtattgatccgcggtggacgtgtaaaagacctaccgggggtacgctaccacatcgtgcgtggcgcacttgatactgccggagttgaaaaccgtgcacaaggccgttctaaatacggtacaaaacgtcctaagaaaaaataattccgtttgaatacaaataaaagggtttttaaaagcaaggagttctggcaatgctgttaagggcgtcgggcttttcgcgccaagcgtcagtttgatcccggcagctgaaccgtgaaatccctctgcttgctgtaaacccgtaacaagagaagggaggataatcagatgccacgtaaaggtcctgtagcaaaaagagacgttttacctgatccgctttacaactctaaactggttactcgtttgatcaacaaaatgatgatcgacggtaaaaaaggtaaagctcaaacaatcctatacaagtcattcgatattattaaagaacgtaccggcaacgatgcaatggaggttttcgaacaagcattgaagaacatcatgccagtgcttgaagttaaagcacgccgcgtaggtggtgcgaactaccaagtacctgtagaggttcgtcctgaacgccgtacgactcttggacttcgctggttagtaaactacgctcgtcttcgcggagaaaaaacgatggaagagcgtttagctaacgaaatccttgatgcagctaacaacactggtgctgctgttaagaaacgtgaagatactcataagatggctgaagcaaacaaagcgttcgctcactatcgctggtaatctcacacgacaaaatattattccctaagaaggaaggagaaaagacccaatggcaagagagttctccttagaaaaaactcgtaatatcggaatcatggctcacatcgatgccggtaaaacgacaacaactgaacgtatcttgttctacacaggccgtatccataaaattggtgaaactcacgaaggggcttcccaaatggactggatggagcaggaacaagaacgcggtatcacaatcacatctgctgcaacaactgcacagtggaaaggctaccgcgtaaacatcatcgacacaccaggacacgtagacttcacagttgaggttgaacgttccctgcgcgtacttgatggtgccgttgccgttcttgacgcacaatcaggcgttgagccgcaaactgaaacagtttggcgtcaggcgacaacttacggagtacctcgtatcgtatttgtcaacaagatggacaaaacgggtgcggacttcctttactctgtaggaactcttagagaccgtcttgaggcgaacgctcacgcgatccaattaccgattggcgccgaagacaatttcgaagggatcatcgaccttgtagaaaacgttgcgtactactatgaagatgaccttggaacacgctctgaagcgcgtgaaatccctgctgagtacaaagacaaagctgaagagcttcgcgctagcttgattgaagctgttgctgagcttgatgaagagcttatgatgaagtacttggaaggtgaagaaatcacagttgacgagctgaaagcagcaatccgcaaaggaacttgtaacgttgagttctatccggttctatgtggttcagctttcaaaaacaaaggtgttcaattagtgcttgacgcagttcttgactacctgccagctccaactgacgtaccagcaatcaaaggtactctgcctgattctgatgaagaggttactcgtgagtcttctgacgatgcacctttctcagcgcttgcatttaaagttatgactgacccttacgttggtaaattgacgttcttccgtgtgtactcaggaacacttgattccggttcatacgtaagaaactcaacaaaaggcaaacgtgagcgcgtcggccgtatcctgcaaatgcacgccaacagccgtgaagaaatctctactgtgtacgcaggggatatcgctgctgctgtaggtttgaaagacacgactacaggggacacgctttgcgacgagaaaaaccttgttatcctggaatcaatggaattccctgagcctgttatccacgttgcaatcgagcctaaatctaaggctgaccaagacaaaatgtctactgcactggctaaattggctgaagaggatccaacattccgtgcgcatactgaccctgaaacaggtcaaacgatcatcggcggtatgggtgagcttcaccttgatatcatcgttgaccgtatgaaacgcgaatttaaagttgaagccaacgtcggtgctcctcaagttgcgtatcgtgaaacattccgtgcgagcgcgcaagttgaaggtaaattcgtacgtcagtctggtggacgcggacagttcggacacgtttggatcgaattctctccaaacgaagaaggaaaaggctttgagttcgaaaacgcaatcgtcggtggtgtcgttcctcgtgaatacattccggctgttcaagcaggacttgaagatgcacttcaaaacggtgtagtcgcaggttaccctgttatcgacatcaaagcgaaactttttgacggttcttaccacgatgtcgactctaacgaaatggcgtttaaaatcgctgcttccatggcgcttaaaaacgcggcaagcaagtgtaacccagttattcttgagccgatctccaaagttgaagtcgttatcccagaagaatacatgggagacatcatgggcgacattacgtcacgccgcggtcgcgtagaaggtatggaaggacgcggaaacgctcaggtcgttcgcgcgatggttccactttctgaaatgttcggttacgctacggctctccgttcaaacacacaaggacgcggtacgttcacaatggtctttgaccactatgaagaagtgcctaagagcatcgctgatgagatcatcaaaaaaaatcaaggtgaataattgattttgcctcttcattaaagtataactactattgtaagatgagaaagtgaaacattgctttcactttctatcactctatataacaaaaactaacctttttaaggaggattttcagaatggctaaagaaaaattcgaccgttccaaatcacatgccaacattggtacaattggacacgttgaccatggtaaaactacattaacagctgctatcactactgtgcttcataagaaatctggtaaaggtactgctatggcatacgaccaaatcgacggtgctccagaagagcgcgagcgcggtatcacaatttctactgcacacgttgagtacgaaactgacaaccgtcactatgcacacgttgactgcccaggacacgctgactatgttaaaaacatgatcactggtgctgcgcaaatggacggtgcgatccttgttgtttctgctgctgacggcccaatgccacaaactcgtgagcacatccttctttctcgtaacgtaggtgtgccttacatcgtagtattcttgaacaaatgcgacatggtagacgacgaagagcttcttgagctagttgaaatggaagttcgcgatcttctttctgagtatgagttccctggtgacgatgtaccagttatcaaaggttctgctcttaaagctcttgaaggagatgctcagtacgaagaaaaaatctttgaactgatggctgctgttgacgagtacatcccaactccagagcgtgaaactgacaagccattcatgatgcctgttgaggacgtattctcaatcacaggtcgtggaacagttgctactggacgcgtagagcgcggacaagttaaagtcggtgacgaagttgaaatcatcggtcttcaagaagaaaacaagaaaacaactgttacaggtgttgaaatgttccgcaagcttcttgactatgcagaagctggagacaacatcggtgcacttcttcgcggtgtatctcgtgaagaaatccaacgcggtcaagtacttgctcaaccaggtacaatcactccgcacaaaaaattcaaagctgaagtttacgttctttctaaagaagagggtggacgtcacactccattcttctctaactaccgccctcagttctacttccgtacaactgacgtaactggtatcattcagcttccagaaggcgtagaaatggttatgcctggagacaacatcgaaatgactgttgaattgatttcaacaatcgcgatcgaagacggaactcgcttctctatccgtgaaggcggacgtacagttggttctggcgttgtttcttcaatcatcgaataatacttataaaataaaaaacgagatccagccgggtctcgttttttattttgagccgctatgctaaagggatttattttccgcctgtaagtccttgattaacactgcttgaatctgtataataaaaaaagtgtgcaaaagccggtaatattcaatattaccttgcaacatgcctataaattttgtataatagtgcatgttggtctttgactgcgatgaagtgagaggttgctgacacacccggccgctttgccatggcaaggtgattcaggtttttctcacggagaattgtctaatgtaagtaggcgaaaaggagggaaaataatggcaaaacaaaaaattcgtattcgtttaaaagcgtatgatcatagaatccttgatcaatctgctgagaagattgttgaaacggctaaacgttccggagccagcgtttctggtccgattccgttgccaactgagaaatcagtttacacaatccttcgtgcggtgcacaaatacaaagattctcgtgagcaattcgaaatgcgtacacataaacgtttgatcgacattgtgaacccaacaccacaaactgttgatgctctaatgcgattagatttaccatctggtgtcgatatcgaaattaaactttaatctaaaatatagaatgatctttataggaggtgtgacgaatgaccaaaggaatcttaggaagaaaaattggtatgacgcaagttttcgcagaaaacggtgatcttattccggtaactgttatcgaagctgctcctaacgttgtgcttcagaagaaaacttctgaaaacgacggctatgaagcgattcagatcggttttgacgacaagcgtgaaaagcttgccaacaaaccagaaaaaggacacgttgcaaaagcggaaactgctcctaagcgcttcgttaaggaattacgcggagtggatatggatgcgtatgaagttggtcaggaagtcaaagttgatattttctctaacggagaaatcgtagatgtaacaggaacatcgaaaggtaaaggtttccaaggcgctatcaaacgccacggacaatctcgcggaccaatgtctcacggttcacgctaccaccgccgtcctggttcaatgggaccggtagaccctaaccgtgtattcaaaggaaagctgttgcctggacgtatgggcggagagcaaatcactgttcaaaaccttgaaatcgtaaaagtagatgcagagcgcaaccttcttttagttaaaggtaacgttcctggtgccaaaaaatcactagtcactgttaaaagtgctgttaaatctaaataattctcttaggaaaggaggaaattgatcatgccaaaagtagctttatataaccaaaacggttctactgctggtgatatcgaattaaacgactctgtatttggaatcgagccaaatgagagcgtagtattcgacgctattcttatgcaaagagcttccttgcgtcaaggaactcataaagtaaaaaatcgttcggaagtacgtggcggaggtcgcaaaccttggcgtcaaaaaggtaccggccgtgctcgtcaaggatctatccgttcaccgcaatggcgcggaggtggtatcgtattcggtcctacaccacgcagctatgcatataaattaccgaaaaaagttcgccgcttggctatcaaatcagcattgtcttctaaagtgaatgacaacaacttgatcgttcttgaagatcttaatcttgatgcggttaaaacaaaagaaatggcagctatccttaaaggtctgtctatcgagaagaaagctttaatcgtaactgcggatgcaaacgagacagttgaactatctgctcgcaaccttccaggagttactgttgttgaagctaacggaatcaacgtcctcgatgttgtcggtcacgagaagcttgtgatgacgaaagcagcggttgaaaaagtagaggaggtgcttgcataatgaaagatcctcgtgatgttctaaagcgccccgtcattactgaacgttctgctgatttaatgactgaaaaaaaatatacgtttgaagttgacgtaaaagccaacaaaacagaagtgaaagacgctgttgaacaaatctttggagtgaaagttgaaaaagtcaacatcatgaactacaaagggaaattcaaacgtgtcggccgctactctggtatgacaaacaaacgcagaaaagcgattgttaagcttactgaagacagcaaagaaatcgaaatttttgaagcttaatcacttgtaaaaagaaggagggaaattcaaaatggcgattaaaaagtacaaaccgacctctaacggacgtcgcggcatgacttcttctgatttcgcggaaatcacgacagatcagccggaaaaatccttgcttgccccgcttcacaaaaaaggcggacgcaacaaccaaggtaaattaactgtacgtcatcaaggcggcggacataaacgccaataccgtattatcgacttcaagcgcgataaagatggtatacctggacgcgttgctacagttgagtacgatccaaaccgttcagctaacattgctctaattaactatgtagacggagaaaaacgctacatcctagctcctaaggggcttcaagtaggcactgaaatcatgtcaggtccagaagctgacattaaagtaggtaacgcacttccactgatcaacatccctgttggtacagttgtgcacaacattgaattaaaacctggaaaaggcggacagcttgtacgttcagctggtacatctgctcaagttcttggtaaagaaggtaaatacgttcttgtacgtcttaactccggtgaagttcgcatgattctttctgcttgccgcgcaacaatcggtcaagtgggtaacgaacagcatgaactgatcaacatcggtaaagccggacgttctcgctggaaaggcgttcgccctacagttcgcggttctgttatgaaccctaacgatcacccgcacggtggtggtgaaggacgcgctccaatcggacgtaaatcacctatgtctccatggggtaaaccaactcttggattcaaaactcgtaagaaaaagaacaaatcagataaattcatcgtacgtcgtcgtaaaaataaataacggggttgtctacggttcatatcggaccgtagtgcaatcacgaagggaggttccaaaatggctcgcagcttaaaaaaaggaccatttgtcgatgatcatctaatgacaaaaatcgagaaattaaatgaagcggataagaaacaagttgtgaaaacttggtctcgccgttctactattttcccgcaatttatcggtcacacaatcgcagtctatgatggacgcaaacatgtgcctgtttacatctctgaagatatggtaggtcacaagttgggtgaattcgcaccgactcgcacttacaaaggtcatgctagtgatgacaagaaaacaagacgctaatgagaggaggcttttaaatgcaacaagctaaagctgtcgcaagaacagtccgtattgctcctcgtaaggcacgtctagtaatggacctgattcgaggcaagcaagtaggtgaagcagtatcgatcttaaaccatacgccaaaagctgcttccccgattattgaaaaagttttaaaatctgctatcgccaacgctgagcacaactacgaaatggatgcaaacaacctggttgttactcaagcttacgtgaacgaaggccctacgttgaaaagattccgtccgcgcgctatgggacgtgcaagccaaatcaacaaacgtacgagccacattactatcgttgtatcagaaaagaaggagggataactcgtgggtcaaaaggtaaatccagtcggtcttcgtattggggttatacgtgattgggaatctaagtggtacgctggcaaagattacgctgacttccttcacgaagatctgaaaatccgtgaatttattaatcaacgcctgtctgacgcttcagtttctaaagtagaaatcgagcgtgcggcaaaccgtgtaaatattacgatccacacagctaagcctggtatggttatcggtaaaggcggttccgaagtcgaagcgcttcgcaaagcccttaacagccttactggcaagcgtgtacacattaacattcttgaaatcaaaagagctgatcttgatgctcagctagttgctgataacattgctcgtcaattggaaaaccgtatctctttccgtcgtgcgcaaaagcaacaaatccaacgcacaatgcgcgctggtgcacaaggaattaaaacaatggtttccggtcgtcttggcggcgctgacatcgctcgttctgaatactacagtgaaggaactgttccattgcacacacttcgtgcagacatcgactatgctacatctgaagctgacacaacttacggtaagcttggtgtaaaagtctggatctatcgtggagaggttcttcctactaagaagaaaactgaggaaggaggaaaataatatgttaatgccaaaacgcgttaaatatcgcagagagcatcgcggaaaaatgcgcggccgtgcgaaaggcggcactgaagtgcatttcggtgaatacggtatccaagctcaagaatcttcttggatcacaaaccgccaaatcgaagcagcacgtattgcgatgactcgttacatgaaacgtggcggtaaagtttggatcaaaattttcccttctaagccttatacagctaagcctctagaggttcggatgggttccggtaaaggtgctcctgaaggatgggtagctgttgtaaaaccgggcaaagttttatttgaaatttctggtgtgtctgaggaagtcgctcgcgaagctcttcgtcttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaacactgctcgcattcgtgaagtgcgcaagtcaatcgcgcgcatgaaaactgtgattcgggaaagagaaattgctgccaacaaataattccggagggaggttctctaaaacatgagcgaacgcaatcagcgcaaagtctaccaaggacgtgttgtttctgacaaaatggataaaaccattactgttgttgtagaaacatacaaaaagcattcactctacggtaaacgcgtaaagtactctaaaaaattcaaagcacatgatgaaaataaccaagctaaaatcggagacatcgtaaagatcatggaaactcgtccattatctgcgactaaacgttttcgtctagttgaagttgtcgaagaagctgttattatctaataaagttcggaaacttttttccgaagggaggtaacaaataatgattcaacaagagactcgtttaaaagtagctgataactctggtgcccgtgaagtgttaacaatcaaggtgcttggtggttctggacgcaaaacagctaacattggtgatgtcattgtttgcacggttaaacaagcaacaccaggaggcgttgtcaaaaaaggtgatgtcgtgagagctgtagtcgtacgttctaagagcggtgcacgcagaaatgacggatcttacatcaaattcgatgagaatgcatgtgttatcatccgtgacgacaaaagcccgcgcggaactcgtatcttcggacctgtagcacgtgaacttcgtgataacaacttcatgaaaattgtttctctagctccagaagtactttaatgatatcaatgccggactaaggaggtgcgatcaggatgcatgttaaaaaaggcgataaagtaatggttatctctggtaaagacaaagggaagcaaggtgtaattcttgcagctttccctaaaaaagaccgcgtaatcgttgagggtgtcaacatggtgaagaagcactcaaagccgactcaagcaaaccctcaaggcggaattttaaatcaagaggcgccaattcatgtgtcaaacgtaatgccgctcgatcctaaaacaggtgaagtgactcgcgtaggatacaaagtagaaaatggcaaaaaagttcgtattgcaaaaaaatctgggcaagttctagataactagtaataaaggaagggaggtctatctcatgaaccgccttaaagaaaagtacaataaagaaattacacctgcattaatgaaaaagttcgaatacaaatctgtgatgcaagtgcctaaaatcgaaaaaatcgtaatcaacatgggtgttggtgacgctgttcaaaacgctaaagctatcgatagcgctgttgaagaactaacgtttatcgctggtcagaaacctgtcgttactcgtgcgaagaaatctattgctggattccgtcttcgtgaaggaatgccaatcggtgcgaaagtaactcttcgcggagagcgcatgtacgatttccttgataaactaatttctgtttctttaccgcgtgtacgtgacttccgcggaatttcaaaaaaatcttttgacggtcgcggaaactacacactaggaatcaaagaacagctgatcttccctgaaattgactatgataaggtaactaaagttcgcggtatggatatcgttattgtaacgactgccaacactgatgaagaagctcgtgaactgttaactcaattaggtatgccattccagaaataatcaatgaaagggaggcgaaatcgtggctaaaaagtcaatgattgcgaaacaaaaacgcacaccgaagtttaaagtacaagagtacactcgctgcgaacgctgcggccgtccgcactctgttattcgtaaatttaaactttgccgtatttgtttccgtgaacttgcatataaaggacaaattcctggcgttaaaaaagccagctggtaatccccgtttatgggaaggaggttattaaataatggttatgacagatccgattgcagatatgctgactcgtattcgtaatgcaaacatggtacgtcatgagaagctcgaaattcctgcttctaagttgaaaagagagatcgctgaaatcttgaaaagagaaggtttcatccgtgacgtagaattcattgaagataacaaacaaggcatcatccgtgttttcttgaaatacggacaaaacaacgagcgtgtcatcactggccttaaaagaatcagcaaaccaggtctgcgcgtttacgctaagtcaaacgaagtgcctcgcgtgcttaacggacttggaatcgcaattctttctacatcacaaggtgtgttaacggataaagaagcccgcgctaaacaggctggcggagaagtattagcatacgtttggtaagaagtttaacatgaatggaggtgtttggtatgtctcgtgtaggtaagaagctacttgagattccttcaggcgttacagttactctgaacgacaacactgtaaccgtgaaaggaccaaaaggagaattaactcgtacgtttcatcctgatatgaagattaaaattgaggacaatgtacttactgtagaacgtccttcagataataaagaacaccgtgcgctgcatggcacaactcgcagcatcatcggaaacatggttgaaggtgtatctaaaggttttgaaagaggtttggaattagtcggtgtcggttaccgtgcttctaaatccggaaacaaacttgttttgaacgttggatactctcaccctgtagaaatcgttcctgaaaacggaattgaaatcgaagttccatctcaaacaaaagtggttgtaaaaggtacagataaagaacgtgttggagctactgctgcaaacattcgcgctgtacgttctccagagccttacaaaggcaaagggatccgctatgaaggagaaatggttcgtcgtaaagaaggtaaatctgctaagtaaaaccgcttaatgtgagaaaggagtgacccagatgattacgaaaacaagcaagaatgctgcacgtcttaaaagacacgctcgtgttcgtgcgaagctttcaggaacccctgaaagacctcgtctaaatgttttccgttcaaacaaacatatttacgcacaagtgatcgatgacgtgaacggtgttacacttgtgagtgcatctactcttgataaagactttaacgctgaaaatggcagcgatacggctgcggctgcaaaagttggagagcttgttgcaaagcgcgcttctgaaaaaggtatcacaaatgtcgtgttcgaccgtggcggttacctttatcatggacgtgtaaaagcattggctgatgctgcacgcgaagctggattagaattttaataaaagaaggagggacatatgaatatgcgtcgtattgacccaagcaaattagagttagaagaacgcttagttaccgttaaccgcgtagcgaaagttgttaaaggtggtcgtcgtttccgtttcgcagctctagtcgttgtcggtgacaaaaacggtcacgttggtttcggaactggtaaagcacaagaagttccggaagcgattcgcaaagctgttgaagatgcgaaaaagaatttgatcgaagtaccaatggttggaactacaattccacacgaaatcatcggacgtttcggtgcaggaaacatcttgttaaaacctgcttctgaaggtacgggagtcatcgctggaggcccagtacgtgcggtacttgagcttgcaggtgtatctgatatcctttctaagtctttaggttctaacacaccgatcaacatgatccgtgcaacagtccaaggtttaagcgagctgaaacgcgctgaggacgttgcgaagcttcgtggaaaatctgtagaagaactgttaggataaggagggaacattaatggctaaattagaaattaccctcaaacgcagtgtaatcggacgcccggaagatcagcgcattactgtaagaacgcttggtttaaagaaaacaaaccaaactgtcgttcatgaagacaacgctgcaatccgcggtatgattaacaaagtatctcatttagtttctgttaaagaactttaaaaataaacgataggctaaggaggtgtccaaatgaaacttcatgaattaaagcccgcagaaggttcacgtaaaacgcgcaaccgcgtaggtcgtggtattggttctggtaacggtaaaacagctggtaaaggtcataaaggtcaaaacgctcgttctggcggcggtgtacgtcctggattcgagggtggacaaatgcctttattccaacgtcttcctaaacgcggtttcacaaacatcaaccgcaaggaattcgctgtggtcaacctagacaaactcaacagctttgcagaagggacggaagttactcctgaacttcttttagaaacaggtgtaatcagcaagttgaaatctggagtgaaaattcttggcgacggtaaattagaaaagaaattaactgttaaagccaataaattctccgcttctgctaaacaagcaattgaggctgctggcggtacagctgaggtgatctaacttgtttaagacaatctccaattttatgcgtgtgaaggatattcggaataagattatcttcactcttttaatgcttatcgtctttcgtctcggttcgttcattcctgtgccgcacgtaaacacagaagttttaaaggcacaggatcaaatgagcgtatttgggattctaaacacatttggcggcggtgcattgttcaacttctccattcttgcgatgggaatcatgccttacatcacagcttctatcatcatccagctcctgcagatggatgttgtgccgaagtttaccgaatggtctaagcagggggaagttggtcgccgaaaactagctcagttcacaaggtacttcacgatcgttcttggatttatccaggctttaggtatgtcttacgggtttaacaacatggccggcggcgcgttgattacagacccgggagtcggtacttatttgcttattgcgattgtactaactgctggaactgcttttttaatgtggctgggagaacaaattacgtctcatggagttggtaacggaatatccattatcatcttcgccggtatcgttgccggtattccgcagacgattaatcagatctacgctcagcagtttgtagatgctggagatcagttattcttgcaaatcataaaggttgtcgttatattggttgcgattttagcgattgtcgttggcgttattttcatccaacaggcggttagaaaaatctcaattcaatatgcgaaaggttcaggccgttcaccggttcctggcggccagtctacacacttgccgctgaaggttaacccggcgggagttattccggttatctttgccgtagcatttatcaccactccgcggaccgtggcaacattctttggctccaatgacgtcacgaattggattcaaaaaacgtttgattacacgcatccggtcggaatgggagtttatgcagcattgatcatcgcctttacctatttctatgcatttgtgcaggttaaccctgagcaaatggccgataatcttaaaaaacaaggcggctatattccgggagttcgtccaggaaaaatgactcaagatagaattacgagcattttgtatcgacttacatttgtaggctccatattcttggccgtgattgccattcttcctgtcttgttcgttaatattgctgggctgccttcttctgcacaaattggtggaacaagtttgctgattgtcatcggggttgcacttgaaacaatgaagcagcttgaaagccagctggtaaaacgaaactatcgtggatttatgaagcactagaggaaatggggcgcgcccattccctctaaaatagagaggacggggaatccgaaatgaacttagtcttaatgggactgcctggagccggtaaagggacacaggctgaacggattgttgaagattttgggatacctcatatctcaacaggagacatgttccgcgctgcgatgaaagaagaaacggatctgggactcgaagccaaatcatacattgataaaggcgagcttgttccggatgaagtgacaattggtattgtcagggagagacttggcaagaatgattgtgacggaggttttcttctggacggatttccgagaacagtcgctcaagctgaagcacttgaggaaattcttaaaggacttggcaagtcgattgaccatgtcatcaacattcaagtcgataaagatgcattgatggaacgtctgacaggacgcagaatctgcaaaaactgcggtgcaacttatcatttagtctttaatccgcctgcaaaagaaaatgtatgcgacaagtgtggaggagagctttatcagcgtgaagacgataatgaagctaccgtatccacgcggttagaggtcaacatgaagcaaacccagcctttactcgatttctatgaagataaaggatatctcgtaaacattgacgggcagaagcacatcaatgaagtttacgctgatataaaggagcttctcggaggccgggacaaatgattatttgtaaaactccccgagaaatcgaaatcatgcgggaggccggacgaattgtcgctttaactcatcaggagctaaaaaagcacattaaacccggcatctcgacaaaagaattggatcaaattgccgaacgttttattacaaagcaaggtgcaatcccatcttttaaagggtataatggttttcgcgggagcatttgcgtttcggtcaacgaagaactcgtgcacggtattccgggaaaacgagtccttcgcgacggggacatcatcagcatcgatatcggtgcgaagctaaacggttatcatggtgactccgcttggacttatccagtgggtacgatcagcgatgatgatcagaagctgctggatgtgacagaggagtctttatatagaggcttgaaggaagcaaaaccgggagaacgtttgtcgaatatttcccacgcaatacaaacgtatgtcgaaagcgaacaattttcagtcgtcagggaatatgtaggacacggggtagggcaggatctgcatgaggatccgcaaattcctcactacggtccgccgaacaaaggcccgcgtttaaagcctggcatggtcttggccattgagccgatggtcaatgcaggtacacgctatgtcaaaacattggctgacaactggacggttgtaactgtggacgggaagaagtgtgctcactttgaacacacgattgccattacggatgccggttttgagatactgacaaaagcctaggtgaaatgagatgtatcggaaaacacctgaaattggacagttcgtacgcatgacaagaggccgcgaaatgaaccaatacgcagttgttattgatatagtcgatcatcatcatgtgctggtagcagacggagaaaagcgtaaatttcattctcctaagaaaaagaatatcaatcatttaaccttttatgattgcgtatctccggaagttcagaacagtataaacgaaacagggcgtgtgacaaacggaaaattgagattttctcttttgaaatttgtcagagagcaagttactgatttgaagaagggagaacacttgaatggcgaaagacgatgtaattgaagtggaaggtactgtagtcgaaacgctgccaaacgcaatgttcaaagttgaacttgagaatggccacacggttttggctcacgtatctggtaaaatccgcatgcacttcattcgcattttacctggagacaaagttacggtagaattatctccatatgacttaactcgtggtagaattacgtaccgttacaaataaagcactccggaaattgaaggaggttggaaacacatgaaagtgagaccatcagttaaaccgatctgtgaaaaatgcaaggtcattcgcagaaaaggaaaagtaatggtgatctgtgaaaatccaaagcataaacaaaaacaaggataatttttaaggaggtgcgagagagatggctcgtattgctggtgtagatatcccacgtgataaacgtgttgttatttcattaacatacatctttggaatcggtcgtacaacggctcagcaaatcttaaaagaagctggagtttctgaagatactcgcgttcgtgatttgactgaagaagaacttggtaaaatccgtgacgtgatcgacaaattgaaagtagaaggtgaccttcgccgtgaagtgtctcttaacatcaaacgtctgatcgaaatcggaagctaccgcggaattcgtcatcgtcgcggattgcctgttcgcggtcaaaatactaaaaataacgcgcgtactcgtaaaggtccgcgtcgtactgtagctaacaagaaaaaataagcaagggaggtaattaaacaatggctgctgcacgtaaaacaaacacgcgtaaacgtcgcgtgaaaaagaatattgaatctggaattgctcatatccgttcaactttcaacaacacgattgttactatcacagatgttcatggcaatgctctttcttggtcaagtgccggagctttaggatttaaaggttctaaaaaatccactccattcgctgcacaaatggctgctgaaacagctgctaaaggttctatcgaacatggacttaaaactcttgaagttactgtaaaaggaccaggttccggccgtgaagctgcaattcgtgcacttcaagctgctggactagaagttacagcgatcagagacgtaacgcctgttcctcataacggatgccgtccgccaaaacgtcgccgcgtgtaatttgtttgtatagattttgtgtccctgtcaataatgggttatgatacagttaatttataaaacgaatgcacactcgttgcctgagcacatacgggactaaacaatggggaatttcggatagaatcagagaaattctttccggggtttcgacgttttgaaggagggttttatgaaatgatcgagattgaaaaaccaaaaatcgaaacggttgaaatcagcgacgatgccaagtatggtaaatttgtcgtagagccacttgagcgtggatatggtacaactttgggtaactccttacgtcgtatccttttatcctcactccctggtgccgctgtaacatcgatccaaatagatggtgtactgcatgaattctcgacgatcgaaggcgttgttgaagatgttacaacgattatcttaaacattaaaaaacttgcactgaaaatctactctgaagaagagaagacgcttgagattgatgttcagggtgaaggagttgtaacagctgctgatattacccacgacagtgatgttgagattttgaatcctgatcttcacattgcgactcttggccaaaatgcgagttttcgagttcgcttaaccgctcaaagaggtcgcgggtatacaccagctgacgcgaataaaagagacgatcagccgattggcgtcatcccgattgattccatctttacacctgtttctcgcgtatcttatcaagttgagaatactcgtgtgggtcagattacaaactatgacaaacttacgcttgacgtatggacagatggaagcactggaccaaaagaagctattgcacttggttcaaagattttgactgaacaccttaatatttttgtcggtttgaccgacgaagctcagcacgctgaaatcatggtagaaaaagaagaggatcaaaaagaaaaagttcttgaaatgactattgaagaactcgatctttcagtccgttcttacaactgcttgaagcgtgcaggaatcaatacagttcaagaacttgcgaacaaaactgaagaagatatgatgaaagttcgcaacctgggccgcaagtcgcttgaagaagtaaaagcgaaacttgaagaacttggacttggccttcgcaaagacgattgactagtttccatgtgaactaggattttcgtgtgttttttatttcagatagagtatttcaataaaggaggggacaccacatgtcatacagaaaactaggacgcactagtgcacagcgtaaagcaatgctgcgtgatcttacaacagacttgatcatcaacgagagaattgaaacaacagaagctcgcgcgaaagaacttcgctctgttgtagaaaaaatgattacacttggcaagcgcggagatttacacgcacgccgccaagcagctgcatacatccgcaatgaggttgcagatgcagagaaaaaccaagatgcacttcaaaaacttttctctgatgtagcacctcgttatgaagagcgccaaggcggatacacacgtattatgaagcttggtcctcgccgtggtgacggagcaccaatggctatcatcgaattggtttaatcacatattttgtgtgtctaaagaagggcgggacagtttttaactggatctatgccctttttttagataccggggaattttctatgataaaagaatagtcagaaaagcagagctttagaggagaggaggccggacgggcaaatgaatcaagagcgattaatcgctgcagaagatatcacgtttcgctaccagaaagatgcagacaggcctgcgcttgatcacgtatctttccatgtgtcgaaaggagaatggcttgcgatcgtcggtcacaacggttcaggaaagtcgacgctcgcccgtgctttaaacggactgattctgcctgatgaaggatcgattaaagtaggcggtatcaagctgacggaagagacggtctgggatgtccgaaaaaaggtcggcatggtgtttcaaaatccggataaccaatttgtcgggacaaccgtccgcgatgatgtggcttttggtttagaaaacagcggagttccaagagaagacatggtggaaagggtggattgggccgttcaacaggtgaacatgcaagaatttctcgatcaagagccgcaccatctctcgggaggacaaaagcagcgtgttgcgattgcgggagtgcttgctgcccggcctgacatcatgattctcgacgaagcgacttccatgctcgacccgatggggcgggaagaagtgctggatacggtcagaaggctgaaagaccaaggaatggttacggtcatttcgattacccatgacttaaacgaagccgcgaaggccgaccggatcatcgtcatgaacagcggtagaaaatttgccgaaggcacgccgcaggaagtctttcgtctgaatcaagatctgattaaaatcgggcttgatttgccattttcttttcagctcacccaaatgctgaaggaaagcggtctggctctgaaaggcgatcatctgacacaagaaggattggtgaatgagctatggacattgaaatcaaagatgtagagcaccgataccagatgaaaacgccttttgaacgcctggcgatctatgatgtcaacgctgtgattaaagaaggaagctatgtcgccgtaatcggccatacaggatcgggaaaatcgactttgcttcagcacctgaacgggcttttaaaaccgacaaaaggacagatacgcctcggcgaggacgttcttgaagcaggcaaaaagaataaacatctaaaagctttgcggaaaaaggtcggcattgtctttcagtttcctgaacatcagctgtttgaagaaacaattttaaaggatatcgcattcggtccgatcaactttggcatgagccgggaaaaggcggaagaaaaagcgagggaaatgctgaagctggtaggtttgggtgcagagctgtccgacaggtctccgtttgaactaagcggagggcaaatgcgccgcgtggccattgcgggagtgctggcgatggagcctgaggttcttgtcctcgatgaaccgacggcagggcttgacccaagaggccgcaaggagatcatggacatgttctacagcctccataagcagaggaacctgacgacaattctcgtcacccacagtatggaagacgcggcagcgtatgcagatgaactgattgtgatgcataaagggacggtcaaagcaaaagggacgccgcgggagcttttttcaaggaaagacgacattgccgctttagggcttgatttgccggaaacgattaaattccaaaaacgccttgaagagacgctggggattacgttcaaagcgccgattttgacgattgaagaagcagcctccgaagttaaagctctttttcaggaggaaaatgccctatgatggacaatatcattatcggcaaatacgtacccgggaaatcggtcattcatcggctcgatccgcgtacaaagctgttaaccattttcctttttgtctttatcgtttttttcgcgaataatacggaaacatatgcattgctcggcctgtttacggttgcagccgccgctttgtcaggcgttccggtgcgattccttataaaaggaatgaagccggtgttctggattgtgctgtttacgtttctgcttcatatttttatgacaagggaaggaccggttctcgccgatctcggcctgtttaaaatttatgaacaggggcttgttcaagggatttttatttctctgcgctttgtttacctcatcatgatcacaacgattttaacattgacgacgactccaatcgaagtgaccgatggtttggagcatttgctcggtccgtttaaaaaattgaagcttcccgtccatgaactcgctctcatgatgtccatctccctcagatttataccgactttgatcgaagagacggataagatcatgaaagcgcaaatggcaagaggcgtcgattttgcgaacggcccggtcaaagaacgcgtcaaagcgatcgttcctctccttgtcccgctttttgtcagtgcctttaaaagagctgaagagcttgcaaccgcgatggaggcgcgaggatacaggggaggagaaggccgtacaaaatacaggcagctgacatggaaatggaaggatacttccgtgctcctcattttagctgttcttggcgttttgctaattttattgcggacttaggtgatggacgatgagaatgaagtgcacgatttcatatgacggacaccttttttacggctaccaagtgcagcctgggcaaagaacggttcaggatgagcttgaaaaagcgctgcaaacgctccataaagcgaaggagcgtattcctgtcgtttcatccgggcgcaccgacagcggcgtccacgcagtcggacagacgattcattttgacagtccgctatccattcctgaggcgaaatggccgtatgcattgaatgccctgctgcccgatgatatatcggtccgcaaggcggaagctgtcaatgatcaatttcatgcgaggttttctgcgaaaagaaaagaataccggtatatgatatacaggggcagacatccggacgtttttaaacgctactatgcataccatgttccttatgacattgatatggagaaagttaaggaagcctcccgctatctggtcggaacccatgacttcacaagcttttgtgcgaccaaaaccgaagtgaaggataaagtcagaacggtccatgaactggaatggtctgacacaggggacggactgcagatgagaattgtgggaagcggatttttgtataacatggttagaatcattgccggtacgcttcttgatgtaggaaccggcaaattttcccctggtgacattgaaaagatgattcttgccaaaaaccgcgatgccgcagggcgcactgcaccggcacacggcttatatttatggcgtgttatctatgacaactaaaccaggtgtaacattttcttgacagagagtacagaaagttataagatatcatatggtatgtatttcaaccccacgataagccccggaaacttattgtgttttgaaatagaacgtaattgaagtttattgaaaatggcagatcatttaggagggaaatttaatgcgtacaacacctatggctaacgcaagtaatattgaacgcaagtggttagttgttgatgctgctggcaagacgctaggacgtctttctactgaagttgcatctatccttcgcggaaaacataaaccaacttacacaccacacgttgacactggagatcatgtgatcatcatcaacgctgaaaaaatcgagttaactggtaaaaagttaacggacaaaatctactaccgtcacactcaacatccaggcggtttaaaatcaagaactgctcttgaaatgcgtacaaactaccctgagaaaatgcttgaacttgcgatcaaaggcatgcttccaaaaggttctctaggtcgtcaaatgttcaaaaaattgaacgtataccgtggttctgagcatccacaccaagcacaaaaacctgaagtttacgaacttcgcggttaattaaaaaggaggttaccaatttggcacaggttcaatattacggtactggccgtcgtaaaagctctgtagcgcgcgtgcgtttagttccaggagaaggccgtatcatcgtgaataatcgtgaaatcagcgagcacatcccatctgcagctctaatcgaagatatcaaacaaccattaactttgactgaaacagctggtacttatgacgttttagtaaacgtacatggaggcggcttctccggtcaagctggagcaatccgtcacggtatcgcccgcgctttgcttgaagcagatccggaataccgttcaactctaaaacgtgccggtctactgactcgtgacgcacgtatgaaagagcgtaaaaaatacggacttaaaggcgcacgccgtgcacctcagttctcaaaacgttaatttctggcgtttcaaaaactctcaagccatttggtttgggagtttttttattatattttccgccctatatatgaagcggatactggagcagagcccgattccctcgtccagacggagatttggccgatatggtggatctcgtgtgcgattaaatgccttaaaatatcgccttgcgtacagacttcgtctgaccaagccgctttaaccggcagatgttcgaaggcgctggaataattaaaaattacactttctatttctgagcggtgcaggtcggaaaaccgagcgatctgctgaatcgtctggtaatgagagtaatcaggttgaatatccggtttttctaaaatggcgtagatccagcttacttccacatctacaatatgaaacagatttttcttaatgcttcccattccgcctgaacgcttcttgaccagctcctcttgcggctggctgaggcaccacttaaaccatgcatgtcgaacttcccaattatattgaaacaatcctttcactcatctcacctcttctaatattttcggcttcttcctccgtttcccttccttagaagagcatgatttccggctcctgactgcacaatacaaggtaaaaaggaggcggtttctatggggacggtcgtatcttttaacaatgaaaaacaaaagaagcagatcaatttggaaaaacagcttctgcgcgaactgtctttggaaaaaatgctgaattctgcagaggaatgctttgctcctctttttcactttttttctaagcatacggatatcttatatgacggctgcatcgactttgccattgaggcatatttgctgggagccgagtacgggaagttcggctatcacggagaacccgttcatcgagcgatgatccgctcagaaaaagaagaaaaacagctactgcacgagctttatgaatatgctgtcagctggtctgaggcttttaatgttcaagctgcttatgaaccgctctattatgcctgcgaatacttcatccaaagctggtggaaggaaggcttcagccagcgggaaagacgctttaagcttcggctcagataaaacaaagttttatgaaaaagtgaggccaagcttaatcatatttcctttccttgtcccatatcttgtagtaaggacgagcgggagggaaagggatgaagaaaaaaataaaatggctcgggtttttactcggctttgtcgttttattatgtttatttcaatatcaattcaacaatgatgattcttggcggtcatggaatcttccgctgagcggcaaaatcatttatattgatcctggacacgggggcgccgatggaggggcatcaagcggtgaactccttgaaaaagacgtggctcttgaagtatccctaagaatcagggactatctccaggagcagggcgccttggtgatgctgacgcgggaggacgatcatgatctcgctcctgaagaaacgaggggactcagcagaagaaaagctgaagacttgcggaagagggtcgatatgatcaacaattctgaagccgatctttacctcagcatccatttgaatgcgattccttccgcgcgatggagcggtgcgcaaagcttctattacgggcaatatgaagagaatgaacgggccgccaagtttattcaggatgaattaagacataatcttgaaaacacgacgcggaaggcaaagcggatacacggaatttatttgatgcaaaatgttaaaaagcccggggcccttgtcgaaatcgggtttttgtctaacccggaagaggcaaaacagctggccaagcccaaatatcaggacaaaatcgcagcatccgtttataaaggcgtattgcgctactttacagaagacagagaccctcctgaataagagggtttctttttgtgtcaaagacactataaggaaagatatgctatacttattttgtaaacgaatacaacaaagggtgagatcaatgttgcgagaagacgatgtaaaaaagatagtcggcgatttggacgagccatttcttcacaagccgctcagagagctggatgccgtaaaagaaattaaaataaaacccgaaaaacggcacgtcagcgtaaaggtggcgctcgcaaaaacgggatctgccgaacaaatgcagcttcagcaggaaatcgtcatacggttgaaagaagccggtgcagagacggtcggcctgcgttttgaggagctgcccgaagaagtcgtaatgagttatcaagagtctgccaaagggcaggatcaatctctgctgaatagtgaaaaacagcctgtgtttttagctgtggcaagcggcaaaggcggcgtcggcaagtcgacggtgtcggtcaatttggctgtgtccctggcgcgaatcggaaagaaagtcggattaatcgacgccgatatttacggtttcagtgttccggatatgatgggaatcactgtacggccgacgatcgaaggagaaaaggtcgtgccggttgaaagattcggggtcaaagtgatttcgatgggattctttgttgaagacaatgcccctgtcatttggagaggccccatgcttggaaaaatgctgaataacttcttccatgaggttgaatggggggatgtcgattatattatcttagacctgccgccgggaacaggcgatgtagcgcttgatgttcactcaatgcttccaagctgcaaagaggtgatcgtgtcgacgccgcaccctactgccgcgtttgtcgctgcaagagcgggcgcgatggccttgaagaccgatcatgaaatcgtggggatcgttgaaaatatggcttattacgaaagcgtcaaaacaggcgagaaagaatatgtattcggcaaaggcggaggcgaaaagctcgcagaggaactaggcgttccaattctgggcaaaattccgctgaagcagccggattgggatgacagcgaatttgcgccgtccgtttatgatgaaagccacccgaccggcgccatttatttggatatcgccaaaaaaatcgacgaaagcattggcgcaaaagcttaaagagcaaaaaaagcttcctccgcagaagaagcttttagggaatgaaaagcggctcagctttgtttttcttcgccgcctttcatttcttctttcatgctttcagcagcagcttttttcagttcctcttcaaactgctttctgtaaagagggcttgtcagagtgtcagatatgacttcctgcaggtggcttcggaattcctggcttctgacaagttcaccgtattttttggccatttcaggatcctgcatgacctgcatcagcattttttggtactcaggatctttcatcagttttttcagcactttttcatgttcattttgaagtgttttggcaaagccttcagcgaattttggatcttcaaagacttttttccaaaattcagctccttttttggaggtcattgttttttcaacggtttctttgacagttttttcatccattacaagtgtttcatttaatttgtcatcatttaatatttcttgaatcgctttttttccgtcatctgtctttaatatatcgacaaccatttttttggtttgttcatagtccatctcagctgcttggtccgtgggagcacaagctgttacagatagaaacagaaaacagcttatcgatagcattgcggtcttgaacatgcttaagctcctttcgaaaactcgtcttacctttaatatgaatgtcttttaaaaatttatacataacaaaatatcgctgttacagcggtttatttaggggttgggaagtctacaatgaaaagccgtaatctcgtccgatttttcttttccgtattgggtgtcggagctttgactacaagtattgtcggttttgccatagagtggggaagatataaggagctgtttctttccttcgaggtattggagattctgtctgttcttttctggtttatcggggttggcatgatctttagcgtgattgctcaaatgggatttgtgattttcttaacgattcaccgctttgcactggaaattttcagatctcattctttgtggaattcgattcagctgtttttgattatatttgtcgcgtttgacttggtttacttgcgctttctgttttttgaaaaagatggaggctccatcattccgtacatttggctgccgctctttattttggcggtaggcattgcggccgcttatgcaaagcaaaaacagtcctctaaaaaaacgttcgtttccgcattatttctaatgtttgtttttactgtgatggagtggttcccggcgttaagggtcaatgaagaggactggctctatttaatgctgcttcctttattagcctgcaacgcttttcagcttttaatgctgccaaaatttcaggcacgcgcttagaccggctgctactttacttctgaagattttgcatccgtatttgcgattaattcgctgacggttacgtttttgagccccttgcttctgagatggtgcacgatctctggcagggcttcttttgtttgtttggcggaatctgaagcgtgaaagagcacgatgtcaccggcgtttaccgttccatttacgttttggacgatcttttgaacccccgggttcgtccagtcatccgagttaatactataatgaacaacggtgtagccgtactgtttagcaacatcgagtacgtctttattaaactggccggtcggcggtcttaaaagcgtaaggtcgtcaagcccgagtttttgaaaggagtgtcgtgcttttgctaagtcttttttgatctcgcttttcttcatttgcgaatagtttttataagcatagcccatactcccgatctggtgaccatctttacggattctttctacgacatccgggtggcgctctgcccatgaagctgatagaaaaaaggtcgcgtctttaataccgtttgcttttaatgtgtctaaaatgggcattgccttttgatctccccagctgatattaaatgtaagggctacttcatttgtatctgaatctcctctatataccgcttttgctccgccttctgtagaaaacacaggaagagggagcaggttttgcacataaaaaaaacttgctgtcgcaaaagcggctatcataataatgattagctgcttaatccgtttgatatgccacacataaaaatggttcacagaaaaactcctccttgtccatgctgctttgttttcatcctatgcttgtttaaaatagaacataacaataattcatcttaagaaaaaaattaaaaagagggttgaccggaattaaataaacatgttatattgttattcgtcgctgataaacagctgacatgaaaaagctccaaaaaataattttgagaaaagttattgacaaatacgtgagcttgatgttatattattaaagccgctgaacgaagcggaaatgatctttgaaaactaaacaagacaaaacgtacctgttaattcatttttataaatcgcacatttgatttggaacctcattgatacaaacacctaacacttcccggctacatatactaatctaaccttcaaaaactttcttaattttgtatacaaatattgttctttgggaatactgaaacccatggaggtggaatggatgagtaagtctaatcatggggaaacgtgtatcatttgcgaggaaaataaaaccgaaggaattcatctttatacgaaatttttatgttcggattgtgagaaaaagattgtatctacatcaacatcagaccccgaatactctgattatgtcaaaaaattaaagagtctccgtacgccgccattatattcttagaccgtttcaggtcttttttttaagcctttaagtcggtattgaggaaggttataataaaagtggtgaagacacggttaaagtgtcttttttgctatacaccatgaactgaaactttgcttagccgatatccgtattagagagtagtataatgaaacgaccgatttatcataaaaaattaggagtagtggtgtaatgaaaccgattcttcattttatgattcgtgcaactgctgcaagtgcattgtccgtgctcctttggtttacaagcttcttcgcgtttaaccagacttttctgctgtcctccgcttacgcagccggagcctggattgccgtttatcttggcgggaaatggtacggaacctatttatttttaaaagaaaaccagcttacaaggcgggaatatgcctatataaaacagaatctgcgggaagctaagctgaaaattgcccggttaagaaaagccttatttgcagttaaaaacattcaaactattaaacagaatctagaaattcttcggatcgtcagaaaaatttacagcatcacaaagaacgaaccaaagcgtttttatcaggttgaacgcttttattatcaaagccttgattcaattgttgaactgacggaaaagcatgcgtttttggcgtcacagccaaagcgcaatgcgaatcttgaagtttctttaagcgaaacgcgtatgatgatcgataagctcgccaagcaattggaagacgacctttatgacttgctgaaaacagacattgaccacttggagtttgaactggacgtcgcgaagcattcaatgaaaaaaagctgatggaggaaagctgaaatgagcgaatataaaccatcgttacacaaaactggcgcacagcttgaatttgatgatttgctttccgatccttttggacaaggagaagcgcctgtttccggcgtggaggaaaaactccgcgggcagcaagtgaatctggttgatacgttatctgaagaaaaacgccggcaggcatttcaactggccgaacagattgacccgaaaaaccataacagcattactctgtatggaacgcaagctcaatccaaactcttgaacttctcacatgagatgctcgagcacgtccaaaagaaagatgtcggtgaaattgggcaggttttaagcgacctcatgaaaaagcttgaacaggtcagccccgatgaattgaaaactgaaaaaaggaacttcttttcccgtttgtttggaagagtatcccattctgttcaagaagtgttatcaaggtatcaaaaaaccggcgctcaaatagatagaatcagcgtaaaacttgagcattccaaaagcgcactgatcaatgataataagatgctcgaacggctttatgaaaaaaataaagaatattatgaggcactgaatgtctatattgcagccggtcagctgaagctggaagaattaaatcataaaaccattcccgaattaaaagagaaatcgaaaactgaacatcaccatatggccgttcaggaagtaaacgatatgattcagtttgccgaccggctggaaaagcgggtttatgatctaacgttaagcaggcaaattacgctgcagagcgccccgcaaatccgtttgatccagcacacaaatcaagtgctggcggaaaagattcaatcttcgattatgacagcaatccctctttggaaaaaccaggttgctattgcgctcaccctgttgaggcagcgccgagcagtagaggctcaaaaacaggtgtcggccacaacaaacgaactgctcttgaaaaatgccgagatgctgaaggccaatacgatcgaaacggcaaaggaaaatgaacgaggctttattgatattgaaacattgaaacaagtgcaggacaatctgatcggtacacttgaggagacgcttaaaattcaagaggaaggccgttcaaagcggctgcaggcagaagaagaaataagggcaatggaagatggtctcaaggctaagctgctggacatgaaagaaaaccaaaaccgtagatcataagcaagattaacatttaccaaatggtccgccctttatgtaatccgccttgaagggtataataaatgcagaatgtcatatcggcatccggcagcgcctggatgccgaagaaaatagagaagatgactaaaggatcggtttatatgaagacacctttatatacagcattggtgaaccatgctgaaggacatcattattcttttcacgttccgggacatcacaatggagatgtcttttttgatgaagcaaaaactttttttgaaacgattctcaaagtggatctaactgaactgacaggactggatgatttacatgagccatctggcgtcatcaaggaagcacaggatttagtttcgaggctttacggagcggaagaaagcttttttctcgtcaatggttcgaccgttgggaatctggctatgatcctggctgtttgtcagccggctgatacgatactcgttcagcgtaactgccataagtctgtatttcatgcgattgaactttcaggcgcccatccggtttttttgacaccggaaattgatgaggcgatggctgttcccacacatatactgtacgaaacagttgaagatgcaatttcacaatatccgcacgcaaaagggatcgtgttgacatatccaaattactacggccatgcagttgatctgaagccgatcatagaaaaggcccaccaacacgatattcccgttttagtcgacgaggctcacggcgcccattttgtgctgggccatccatttccccagtcgtcgttgaaagcgggcgctgatgccgtcgtccagtccgcgcataaaacgctcccggcgatgacgatggggtcctatctgcatcttaacagcggcaggatcaacagggacagactggcatactatctgtccgtgcttcaaagcagcagtccttcctacccaatcatggcatctttggatatagctagggcatacgccgaagatatcttgaaaacaaatcgaacagccgatattgagaaagagctcatcaatatgagagaagtcttttctcaaataaacggagctgatattgtcgagccggctgatgcccgtatccggcaagatccgcttaagctgtgtatcagatcagcgtacggccactccggttttgaactgaaatccatatttgaagcaaacggcatccatcctgaattggcagatgaaaggcaagtcctgttgatcctgccgcttgaaggaaaaaatatgcccgcgccggaactgatcagcacaatcagtaaagacatgaaagatacagcagttcgaaatgatcttcctgccggaatcggaatcccttctgaaaaagtcacggctttgccttaccggaaaagcaagttgtctgccttcaaaaaagaatcggtgccttttaccgaagcagcgggcagaataagcgccgaatcggtcacaccttatcctccgggcattccgttgatcatggcgggtgagagaataacaaaagagacgatcagccggctgacgcggctcgtcgatctgaatgtacacattcagggcagcaatcagctcaaacaaaagcaattaactgtatatatagaagaggagaaatcatgaacggtttatttattacttttgaagggcctgaaggtgcggggaaaacgacaatccttcaggctgcggcagaccaattgacgaaaaacggccattctgttcttgcgacaagggagccgggcggcattgaaatatcagaacgaattcgcgaggttattttaaatccaagccatacagcaatggatcccaaaacagaggccttgttgtatgcggccgcaagaaggcagcacctagtcgaaaaagtaaaaccggcgcttgaagaagggaaaatcgtcttatgcgaccggttcatcgacagctcgcttgcttatcaggggtatgccaggggactcggcattgatgaagtattttctgttaatcaattcgcgatcggcagcctgatgccgaatgtgacgatttatttcgacattgacccggaagagggaatcaaacgaatcgatttaaatgatgcaagagagaaaaaccggcttgatttggaaaaactccactttcatcagcttgttcaaaaaggctacgaagaagttatgaaccggttccccggacgatttcggattgtggatgccagccaaagtgttgaacttgtgttaaaaagggtaaataacatcattgaggaagcattaaaagaaaatcagttgtgaccagtttaccattcattgttataatggtaacaagagtatccttaaagtgtttccatccaaaagggggcttttcatatgaagttaattatcgctgttgttcaagaccaagacagcaaccggcttttaaaggctttgaccgatcacaattttcgcgtgaccaaactggcgtcgaccggcggctttctgaaatcgggaaacacaaccttcatgttgggtgtagatgatattcgagtagacaaagctttaagcttgataaaagaaaacggaagcaagcgggatcagctgattgcccctgtttctccaatgggcggaaatgctgattcatatgttccttatcctgttgaggttgaagtgggcggagcaaccgtttttgtactgccgatcgagcaattccatcaattttaagggttgaggatatgaaaataagtcaagaactgcgtacaatgatagagaaacagcagactccgcctgcaagaggagaaaatgtttctgcttcatttaaagagaagatgaatatacaaagcggcaagcttcgagttgaacagctgacaatgcttttaacagatattgaagcgttcggaaaacgcctctcaaaatcgagaaacttcaaagatttggccaggttcaaaggcttgatcaaacgatttgtaaaagagaccgttgaaaacggtctgacggtggagaattcaagaagcttcgatctgtacggaaacagccggacattaagcattgtgaaagaactggacgaaaagcttgtgcaattaactgaggatcttatggatcaagaaaaatcctctatcgaacttttggaacgcattggcgaaataaagggtttactgataaacctttacacatagagagtgatggtatggctacaacctggacagaaatgcagaagcttcagccacgggttatgaagcttttgcaaaatagtatagaaagaaatcggcttgcccacgcctatttatttgaagggcgcaaagggacgggcaaattagacgcggcaacccttctggcaaaaagctttttttgccttgaagatggagcagagccatgtgagtcatgcaggaactgccagcggattgaatctggaaaccatccggacgtacacgtcgtccatccggacggcctttccattaaaaagggacaaatccaggcgcttcaggaagagttttctaagaccggtttggaatcgcataaaaagctgtatattatttcccatgcggatcaaatgacggtcaatgcggcgaacagccttctaaagtttttagaggaaccgagcagcgatacaatcgctgttcttttaacggaacagccgcaaaaattgctcgatacgatcatatcgagatgccaggttttatcctttcagtcgctgcagcccgaatcgattgaaaaggaactggtcaaacaagaggtctcaccgaatattgcagcccttttgtcgaatatgaccaacaatttatcggaagcgctcgaattgagtcgaaatgatcagtttgcagagtcgcgagcgaaagtgataaaattgtatgaagtcttacaccagcgaaaaggacatgcttttttctatattcaagatcagtggatgccctttttcaaggagaaagaccaccaagaaatgggtcttgatatgcttttatttatatatcgcgacgtgttgtccattcagttgggacatgaagataaaatactatttcaggacttattccaatcattaaaacagcatgcgctgcaaacaacacaacaaagagtgacaaaccagatacttgctgttttagaagcaaaaaaacggctttattccaatgtgaatgctcaaggattaatggagcacttggttttaatgctgcaggagggataagcttgtacaacgttattggtgtccgctttaaaaaagcgggcaaaatatattatttcgatccgaacggatttcagatagataaagacagctgtgtgatcgtcgaaacggttcgcggtgttgaatacgggcaggttgtcattgccaacaagaaagtagacgagaacgatgtcgtgctgcctttaagaaaagtgatcagagttgcggatgaacgcgaccgcctgatcgttgaggagaatcaagaagctgcgctgtccgcctttgatgtctgccagaaaaaggttaacgagcacggccttgagatgaaactggtcgatgtggaattcacttttgaccgcaacaaagtcattttttattttacggctgatggaagagtcgattttagagaactcgtcaaagatttggcatcgatctttaaaacgagaatcgagctgagacaaatcggcgtcagagatgaagcgaagatgctcggcggtatcggaccgtgtggaagaatgctttgctgttccacgtttttaggtgattttgagcccgtttctattaaaatggcaaaggatcaaaatctgtcgctgaatccgacgaagatttccggactatgcggacggctgatgtgctgtctaaagtatgaaaacgatgaatacgaaacagccaaagaacagcttccggatatcggggaagtgatcgccacgtccagcggcccggcaaaagtcgtcgggttgaatattctcgaacgcattctccaggttgaactgacagactgcgacaaagttgttgaatatacgtgggatgagctgttgcaagaaggtgtcgtatctgcacaaaccacagattaacgaggtgtgaaaccttggataaaaaagaattgtttgatacagtgataagtttagaagaacaaatcgggtccctttaccgccagcttggagatctcaagcagcatatcggggaaatgattgaagaaaacaatcatttacagcttgaaaacgagcatttgcgcaagaggctggaagagacggatcaaaggctaaaaagcgtaaaatccgatgaaaaagagataaaagcagaaaagacagggcatgctgatattggagagggccatgataatttggctcgcctgtatcaggagggcttccatatttgcaacatccattacggaagtgttcgcaaagaaggagactgtctgttctgcctctcgtttttaaataaaaaataagaaaggcttccggcggaacggaagcctttttaacggtacaatgtgtttaggaaagggaaaagacatgattcaattaaaagatgatgaacgactggattatttactggcggaagatatgaaaatcgtgcaaagcccgacagtttttgcattttccttagatgctgttctgctgtcgaaatttgcttacgttccgatacaaaaaggaaacatcattgatttgtgcacagggaacgggattgttccgctgcttctcagcacccgcacaaaagccgccatcaccggggtggaaattcaggaaaggctgtatgacatggccctccgcagcgtggaatacaacaacctgcaaaaacagattcatctcatcagggacgacctgaaaaatatgccgcaggtgctcggatacaataaggccgatgtcgtcacatgcaatcctccttatttcaagacgccgcaaaaaacggagcaaaacctaaatgaacatttggccattgccagacatgaaatctactgcacgcttgaagatgttattcgcgtcagcagcaagctattaaagcagggcggcaaactcgctctcgttcaccggccggggaggctgctcgaaatctttgaattgatgaaggcctttcaaatcgagccgaagcgggtccaatttgtttacccgaaaaaaagcaaagaagccaacaccattttagtagaaggaataaaagacggccgacctgacctgaaaattttgcctcctttgtttgtgtatgatgaacaagatcaatatacacatgaaataaggaagattttatatggagacgaatagccattacttttacgtgctttcgtgccgggacggcagcttgtacgcaggctatacaaacaatatcgaaaagcgcctgaaaacgcataatgacgggaagggcgccaagtatacgagggcaaggctgccggttaaactccattatgcagagtgcttttcaacgaaacgagaagcgatgcaggccgagtactatttcaaaaaattatcgagaaaaaacaaagaacgttatatagaagaaaaaagacgggagggtgttgattatcaaccggcaaaagagttttgaccaaaaatcagacatgggtatgttatatctcgtaccgactcccatcggcaatttagaggatatgacatttcgggcggtttctgtgttaaaagaggcggacattatcgcggcggaggatacgaggcagacgaagaaattgtgccatgtgtatgaaattgagacacagcttgtcagctaccatgaacacaataaagaaagcagcggacataaaattttggaatggctgaaagaaggaaaaaacgtcgcattggtcagtgacgccggaatgccgacaatatctgaccccggggctgaaatcgtccgcgattttatcgaaatgggcggctatgtcgtacccctgcccggtgcaaatgcggctttgaccgcactgattgcctcaggcattgcgccgcagccgtttttctttttcggctttttggaccgcagcaaacgggaaaggaaaaaacagctcgaggctttgaagaacagacaggaaacgatgattttttacgagtcgccgcatcggctgaaagaaaccttggcggccatcagagaggtattcggcaatcggcaaatcgcattgacaagggaactcacgaaaaaattcgaagaatttatcagaggttcgatcgaagaagcactcacatggtctgaacaggaacaggtgcgcggagagttttgccttgtgatcgaaggaagccgtgaagaaacgattgaagaggcggtctggtgggagcatctttcagaaaaagaacatgtcgagcattatatcagcgaaggatatccttcaaaagaagccattaaaaaaaccgcggttgaccgcggcgttccgaaacggaaaatttatgacgcttaccatattcaaaactaaaaaaccgcccttgcttcggcaagagcggtttttgtataatcaaaataattatttttgagattgaagttgtgcttgaatttcgttaatgatttgctcagcgccttcagggctaagaaccaatttaccgcctgcaagtttaaggttgtcatcagaaacctcacctgtaacttggcaagtcatgtttggtttatattttttcaagatgattttttcgtcatctacatagatttcaagagcgtctttttctgcgattccaagcgtacggcgaagttcgattggaatcaccacgcgtcctagttcatcaactttacgtacaatacctgtagatttcatattcattctcctcccgaaagattgttatttttataggtgtttattatcttcgtcattattcgacaaaatccttacagtcctagcataacaaggtttccaataaacgtcaatcattttcttttctattgtttgtaaaaattagatcatatagtcaaaagaccttggaagaactgatgtaacaagggaattgaagatgataaaacagtatgatcaatcaaaaaaaagcccttaaatcaagactttcgaactaaggtttttcctcatatcgattatatacgacattattcgacaatgaaagcatttttttgtcgaagtataatatttctttctgttaagaaatttgtaatcgaccgtattcatgatggatcgacaatgtatattttcttgaacttgaaggctaagatggtatcatataaagagggattatatattgagtatatactgaatgaatacacatgccgctctcgtcctttgggcgggagttttttgacattttaattgggaggttccatcatgccgcaagaaaaaaatacgttttacatcactacacccatttattacccaagtgggaagctacatattggacatgcctacacgaccgttgcaggtgatgcgatggctcgttataaaagactgagaggctttgatgtcagatacttaactggtacagatgagcacggacaaaaaattcagcaaacggcggagaaggaaaacatcactccgcaggaattggtcgatcgtgcggcagaagacattcagcagctttggaaaaagctcgacatatccaatgacgacttcattcggacgacagaggaacgtcataaaaaagtgatcgaaaaggtatttcagaagctgcttgacaatggtgacatatatcttgatgaatatgagggctggtacagcatccctgacgaaacgttttacaccgaaacccagctcgttgatgtcgagcgaaacgagaaaggcgaagttatcggagggaaaagtcctgacagcggccaccccgttgagctaatcaaagaggaatcttacttcttccgcatgggaaaatacgcggatcggcttctcgctttctatgaagaaaatcctgaattcatccagcctgaatcccggaaaaatgaaatgatcaacaactttatcaaaccgggtcttgaagatttggctgtttcccggacgacgttcgactgggggataaaagtgcccggcaatccgaagcatgtcatctatgtttggatagatgcgctgtttaattacattacggcacttggctttaatacggaaaacgatgaaaattatcaaaaatattggccggcagacgttcatcttgtcggtaaggagatcgtccgcttccataccatttactggccgattatgctgatggcattggaccttccgctgccgaaaaaggtttttgcccacgggtggctgctgatgaaagatggaaaaatgtctaaatcaaaaggcaatgtggttgacccggtcacattaatcgacagatacggactagatgcattgcgttattatcttctccgcgaagtgccgttcggttctgacggcgtatttacaccggaaggatttgtcgagcggattaactatgatttagcgaatgatttaggcaacctgctgaacagaacggtcgccatggtcaacaaatactttgacggccggattcagtcgtatgaaggcccggttaccgcttttgacgaaccgttgtcatcattctcgcaaaagacaattgaagcgtacgagcaggcgatcgaaaatatggagttttccgttgcgctttcatcattgtggcagtttgtcagcagaacgaataaatacatcgacgagacagccccttgggtactggcaaaagataaggataaagaaaaagagcttcaatcggtcatgtaccatttggcggagtcattgcgcatcactgctgtattgctgcagccgttcttaacgcagacgcctgaaaagattttcgcacagcttggcgttacggatgcgtcactgaaaacctgggacagcattcaaagcttcggccagctgaaatctgtgacagttcaaaaaggagaaccattgttcccgcgtcttgaggcggaagacgaagtcgcttatatcaaatcaaaaatgcagggaacggctccaaaagaagaaccaaagcaagaggaaaaagcacatgaacggcttccggaaatcacgatagacgattttatgagcacagagctcagagtggctgaagtcattcatgctgaacccgtcaaaaaagcggatcgtctgttaaaactccagcttgatttaggctttgaaaaacgccaagtcgtttcaggaattgccaagcactacaaacctgaagagcttgtcggccggaaagtcatttgtgtaacaaatttaaaaccggtcaaactaagaggagaactttctcaaggcatgatattggctggagaggacaacggcgttctctcgcttgcggcggtagacagttcattagcaaacggaacgcgaatcaaataaatgcaggcaaagggtgttccacgtgtaacatttcgtcgaacaccttttgttttttcgacaatttcttaaaaaggtggcattttcatgttatttgatacacatgctcatttaaacgctgagcaatttaacgaggatttggaagaagtcattgctcgggcaaaggaagaaaaagtggagcacattgtcgtggtaggattcgatcgtccgacgatcaagcgtgcgatggaattgattgaagaatacgattttatttatgcagccatcgggtggcatccggttgacgcaattgatatgaccgatgaagatttggcttggatcaaagacctgtccgcccatgagaaagttgtggcgatcggagaaatgggacttgattatcattgggataagtcgccgaaggacgttcaaaaagaggtgttcagaaaacagatcgctttggcaaaagaagtcggcttgccaatcgtgattcacaaccgtgatgcaacggaggatgtcgtttctattttgcgggaagaaggggccgaggaagtcggcgggatcatgcactgttatacaggaagcgctgaaattgcacaagagtgcatcgatatgaatttctacctatctttcggcggacccgtcacatttaaaaacgccaaaaaaccgaaggaagtggtcaaacaaataccaaatgaccggcttttaattgagacggactgcccgtatttaacgccgcatccatacagaggaaagcggaatgaacctagctatgtcaaacttgtcgccgaacagattgccgaattaaaaggaatgacttatgaagaaatagcggccgtcaccacagaaaatgcaaaaaaacttttcggcatcagctgacacgatttgatatcgagccttgttcaagcttgtctcttcgggggatggttctaaaaagttctacatgtctgtttacgctcataggatatctttgtcgacaagtctttctttcttttatgaggtggttttcccataataaaagagatggcgggcttgcggagaaaatagagaggagggttgacaggcttgtagatactctatataatctccccgaggagaaggaggcgtttttcatcatacaaaaaatgaaaaagctgttttccgtaaagcttagcaaaagcagatggattctgattgctgctggactgcttgtcgcagggagcggaactgcttacggagcacatgagctcgctaaacagcaagtcaccatttcgataaacgggaaaaagcaggatgttcgcacgaatgctaaaaccgtaggtgaactgctgaaaagcttagacatcgagacgaggaaagaagatcacatctctcccgctgaagatacaaaattaacggcgaacatgaatgttgaatatgttgccgcaaaacctgttcatttcacggtcgacggacaggaaaaggaaatctggacaacagcgggtacagtcggcaaacttctgaaagacttaaatttagagttggcggaacacgatcaaattgacccctcagttgataaagaaataacgaaagatatgaagctgactttgcaaagggcttttaaagtaaccgtaaaggatgccggtaaagataaagacctatggacgacttcgactacggtcgctgactttttaaaacatcataagatcagcataaaaggcgatgatgaagttaagcctgcgcttgataaaaagctgacgaaagatcaggcgattcacattactcgtatcaaaaaagtcaccgatgtagtggaagagaacatcccttttgaagtccggaaaaaagaggacgattcacttgaaaaggggaaagaaaaagttgtacaggacggtaaacatggcaagcttaaaaagcactatgccgttgttatgaaaaacggcaaggaagtttccagagaactgattaaagaggaaacggcagccgaaagcaaagccaaaatcatcgctgtcggtacaaagcaagccgcagtggctaaagtcagcgcgaatgtatcgcgcggaaatcaatcctcaggaaaggaattttatgtatcctctacagcttatacagcaagctgcaacggatgctcaggccacactgcgaccggcgttaatttgaaaaataatcccggcgctaaagtgatcgctgtcgatccgagcgttattccgctgggttccaaagtacatgtagaaggatatggctatgcggttgcggccgatacaggctcagccatcaaaggccgaaaaatcgatgtattctttccgaataagtctacagcttaccgctggggaaacaaaagagttaaaatcaaggtgttgaactaaatatcatttattatgctttttatataagcagagggattttgcgccctctgtttttttggttataatagatccatcttgttttctaataaattagacggttttattacaaaaaggtttcaatcattttaaaaatgtaataaaaggtttttcaacatacggaggaagaaatgaagattaaagaaatcatcgttgtcgaaggccgtgatgacaccgctaaaatcaaatcggctgttgatgcagatacgatcgaaacgaacggatctgccataggggaagacgtcatcaaacggattcggctcgcccaggaaacgcgcggggttattattttaaccgatcccgatttcccgggggaaaaaatcagaaaaacgattgcagaaaaggtccccggctgcaagcatgcatttttgcccaagcatttggcaaagcctaaaaataaacgcggaatcggtgtcgaacacgcttcgcttgaagcgatccgcgaatgcttaatgaccgttcaggaggaaatggaagcgacggaacctgagattgaggcccgggatttaatcgaagccggcctgatcggaggcccgctggcaaaacaaaggcgggagcggctcggcgaaatattaaaaatcggctatacaaatgggaaacagcttcaaaagcggctgcaaatgtttcagatcaaaaagagtgattatttaagcgcactggatgctgtgctgcgggaggaagaacatgaataaagatatcgccaccccaattaggactaaggaaattctcaataaatacggattttcattcaaaaaaagcctggggcagaacttcttgattgacacgaacatattggacagaattgtcgaccatgccggtgtgacggagcgtacaggcgtgattgaaatcggtccggggatcggggcattgaccgagcagctggcaaagcgtgcgaagaaagtaacggcctttgagatcgaccaacggcttctgccgattttagaagatacgctttctccgtatgataatgtgactgtcattcaccaggatgtcctgaaggccgatgtccgagcggtaatggacgaacagtttcaagactgcgatgaggtgatggttgtcgccaacctcccgtattacgtcacgactccgatcatcatgaagcttttagaagaaaatctgccgctgaaaggaatcgtcgtcatgcttcaaaaagaggtggcggaccgaatggctgcaaaaccttcttcaaaggaatacgggtccctttccatcgcggtgcagttttatacggaggccaaaacggtcatgaatgtaccaaagaccgtatttgtccctcagcctaacgtagattccgcggtcatcaggctgacgctgaggaaagagccggctgtggccgttcaagatgctgcctttttctttcaagtcgtaaaagcaagctttgcacagcgtcgaaaaacgcttttcaacaacctcgtcaacaatctgccgaatggcaaagagaataaatcaaaaattgaaagagcgcttcaggattcacatatcgacggaaaacgacgcggagagtcgcttagcattgaagagttcgccgtcttatctgaccgcttgagagaagtccttctttaatggagggctttttttattgatgccgggctttaagcctgatcaggcttgtcatccgttcaccacttgaagggcaggcacataggctaaagaagcacctttactttttcgttgcttgatgttcatcaggatggggcttagtctatgtgtggagtgaaaagcatgcaatttaaaataggcgatatggtcgtcagaaaatcttatcgaagagatattttatttcgaattataagaattgatcaatcggcaaatggagaacctgtagccgttttgcacggagatgaggtcagattaatcgctgacgcgcatttgggggatcttgagattgtccgcgaggctgagcggcagatgagaaagcgggaagaagaaacgagaatgaaggaatccctcgatcttctccgccaggattacaaactccttcacgataaacatgagtaccgcgccacaaaccaatataacaatcaacagcagtactttcatatgcccggaagagtccttcatttagacggggattcggcttatttgaaaaagtgtctggcgctctacgaaaagatcggggttcctgtatacggcattcattgctatgaaaagaaaatgtcatcagtcatcgaggaactgatcgatgaataccgcccggatcttctcgtcattaccggacacgatgcctattctaagcagaagggcgatattaacaatctggatgcctacaggcattcaaaagattttatcgaaaccgttcaaaaagcgagaagaaaaattccccatcttgatcagctcgtcatttttgccggcgcatgccagtcccattttgaatcactgatcagagccggtgcaaatttcgcaagctctccgtccagagtcaacatccatgcgcttgatccggtctatatagtcgcaaaaatcagcttcactccgtttatggaccgcattaacgtctgggaagtgctcagaaataccttgacgagagaaaaggggctcggaggtattgagacgcggggcgtattgcgtattggaatgccatataaaacaaaagcaaacgattaaacgagcccgccggatggcgggtttttgctatgcacacgaaatgtttttacctttttttttttaaaacatacataatgaaacgaaaaatgaggaaaataagggaaagtcggcgtataatttgtcacaaatattttattgacagaggcttatgaacgttgatataatttaaattttatttgacaaaaatgggcttctggtgtatactgaatatagtgaggtggatgcaatggcgaaaacgttgtccgatattaaaagatcgcttgatggacatttgggaaaaaggctgacgttaaaagcaaacggtggccgccgaaaaacgattgagcgttcgggcattttagctgagacgtacccttctgtttttgtgatacaactagaccaagacgagaattcgtttgaaagagtttcatacagttatgcggatattcttactgagacggttgaattgaggttttccgatgataaaaccagctcagtagccctttaataagcagtggactttatgtttgctgctttttgttttgcctttttttatccaaaatttttcggggaagttctgcacaaatcgagcaaagctaatacatgtcacttgttttatgatgagtcagacggatggtatgatacttgaaaggggctgtttcgcatgggcagacgtcgaagcatcatgtcagaggaattcaaaaatgaattggctaaagatcttggattttacgatacggtaaagaccgagggctggggcggaattcgggccagagacgccggcaacatggtgaaaagggccatcgaattagccgaacagcatatggctcaaaatcagcaaaatcattaaaacagtgacatacgggggacgcttctgtcctccgtttttttcattgatccgttttcagtgttcagccgctgtaagcgacctgggaatcatggcgaggggcgcattcgcaatctgaaggaatgaccgcatgccaaaggcgaggcatcctgcgcaggcgcatgcatttgtacttgcgaggaatgaccgcatgctaagagcgaggcgtcctgcctcaggcgcatgcatttgtacgtcctgtacttcaaaatatgttacaatgtggatacttatgtttagatggagaagtaggtgaatggattgcgtattttagagaaggcgccggctaaaattaatttgtcgctcgacgttcgccgcaaacgtccagatgggtatcatgaagtagagatggtcatgacgacgattgatttggcggatcgggtcgaattaacagagctggcagaagataaagtaacggtttcttcgcataaccgctttgttcccgacgatcagcgaaaccttgcttatcaggctgcaatgctcatgaaagaacgctacggcattaaaaaaggggtttccatttttattacgaaagtgattcccgttgctgcgggccttgcaggaggaagcagcgatgcggctgccgtcttcagaggattgaaccggctgtgggatttgaagctttcgatgaatgaactggctgagcttggcgctgagatcggatctgatgtctccttttgcgtacatggaggaacggctcttgcaacgggaaggggagagaaaatccgtcatatcgagactccgccgcactgctgggtagtgctggcaaagccgacgatcggcgtatcaactgcagaagtgtacaagcagctgaaagtcgacgagattgaacatccggatgttcaaggtatgattgctgcgattgaagagaagaattttcaaaaaatgtgtgacaagctcggcaatgtactcgaatctgttacattgaatatgcaccccgaagtcgcgatgatcaaaaatcaaatgaagcggttcggcgccgatgctgtgctgatgagcgggagcggccccactgtgttcggacttgttcaatacgaatcaaaagtgcaaagaatctataacggattaagagggttttgcgatcaggtttatgcggtgcggatgatcggagaacaaaatgaacttgattaaatccgtatgttaagttatattgtttttaaaaatattcggattttggaggtaagtgcatgaagtttcgtcgaagcggcagattggtggatctgacaaattatttgttgacccatccgcatgtcttagtgccattaaccttcttttcagaacggtatcaatctgctaaatcatccattagtgaagatttaaccatcattaagcagaccttcgagcagcagggaatcggaacgcttcagaccgtgccgggagcagccggcggcgttaaatacattccaaaggtaaaacgcgatgaagcggaggaatttgtaaagtcgctcggtgagtcattgatcgattcggaacggatattgcccggcggatatttgtatttaaccgatatccttggaaagccctctgtattaacgaaggccggcaaaatttttgcttccgctttttcagacagggagatcgatgtcgtgatgacggtggcgacaaaaggcattcctttggcatatgcggtagccagctaccttgatgtgccgacagtggtcgtcagaaaagacaataaggtaactgaagggtcaacggtcagcatcaactatgtgtccggatcatccaaccgcattcagacgatgtctcttgcaaaacgaagcttgcagacgggctcgcacgttttgatcatagacgactttatgaaagcgggaggaacgatcaacggcatgatcaatcttctcgatgaattcaatgcccatgtagcgggcatcggtgttcttgtggaagctcagggagtcaaggagcggctggtcgatgagtatatgtcccttttgactctttctgaaatcgatatgaaggaaaaaaaggtggaaatacaaaacggaaattttcagcgtttttttgcagaaaatgaataggaaatggggagtttgagatgacaaaggttgttcagacaaaagaagcaccggcggcgatcggaccgtattcacaaggaattgttgtcaacaatatgttttacagttcagggcaaattccgctgaccccgtcgggtgaaatggtgactggagacatcacagaacagacgcaccaggttttccgcaatttaaaagccgtgctgaaagaagcgggcgcctctctggagactgtcgtcaaagcaaccgtgtttctggcggatatgaatcaattcacagaggtgaatgaagtttacggacagtacttcgatacccacaaaccggcgagatcatgcgttgaggtggcgaggctgccgaaagacgcgcttgttgaaatagaagtcatcgcattagtgaaatagaaagaactcttaaaagatggttttggtctcaaaatcatcttttttgtttggaaaatttgtcaattcagtgtttttttatcccaatattacaaaaatatttttaattatgcaggaaaacaaaaaaagccgttgaatagttacactaatgtttttatattgggaaaaggtggtgaactactgtggaagttaccgacgtaagattacgccgcgtgaataccgatggtcgcatgagagcgattgcatccatcacgctggatcacgaatttgtagtgcatgatattcgtgtaattgatggaaacaatggtcttttcgttgcgatgccaagtaagcgtacacctgatggagaatttcgtgatatcgctcatccaatcaactcaagcacccgcggaaaaattcaggacgcggtgttaaatgaatatcatcgtttgggtgacgttgaggaaatagaatatgaagaagctggagcttcttaaaaaagaagggcttatggataagccctttttgttttgaaaaaaaatgatcttatcataataaaatgacaatatatggtttgtgtctgcgtataacagtagcaggaaggtaaagcatgcgaactcggataacaaagcgcatgcagaaggaatcaatccgtctccctgatcagttaatcctaaatatgctctaaacatccaaaatatgctgtcttgatttcccgatttctcattttggcttgcttgaaatcaactcatatttaggatatatttttctatggataatagggataatggaggccaatacatggataagcggtttgcagttgtgttagcagctggtcaaggaacaagaatgaaatcaaagctatataaagttcttcatcctgtttgcggaaaacctatggtcgagcatgttgtcgatgaagctcgcaagctatcattagaaaaacttgtcacaatagttggacatggtgcggaagatgtcaaaaaacagctcggggaaaaaagcgaatatgccctgcaggctgaacagctcggcacggcccatgccgtcaagcaggccaagtcgattcttggaagcgaaaaaggaacaacaatcgtcatctgcggagataccccgcttttaactgccgaaacgatggaagccatgctcacggagcatcagaaaaaagcagcaaaggtgacgattttaaccgctgtagcggaagatccgacaggctacggacgcattattcgcaatgaaaacggcgatgttgcaaagattgtcgaacacaaagatgcaacagaagaggaaaggcttgtcaaagaaatcaacacaggcacctactgttttgacaacgaagctctttttcaaacgatcgagcaggtttccaatgacaacgtacagggggaatattatcttccggatgtcattgagatcttgaaaaatcaaggtgaaactgtagccgcttatcagactggcaacttccaggaaacgctcggagtcaatgacagagtcgccctatcacaagcggaaatctatatgaagcagcggatcaataaacgccacatgcagaacggcgtcagcttaatcgatcccgacaacacatacatttcaccggaagccgtgatcggcagggataccgtgatttatcccggcaccgtcattaaagggcgggttgttatcggtgaagacgcggtcatcggacagaacagcgaactggaaaacagtacggtcggcagcagaacggtcattaagcagtccgttatcgtggacagtgaagtcggcgacgatgttacaatcggaccgtttgctcatatcaggcccgactcaaagatcggcaatgaggtaaggatcgggaatttcgtcgaagtgaaaaaatcggaatttggtgatcgcagcaaagcatctcatttaagctacataggggacgcggaaatcggaacggatgtcaatctcggctgcgggtcgattaccgtaaattatgatgggaaacataagtttaaaacgaaaattgaaaatggggcatttatcggctgcaactccaatttggtcgctccggtgacaatcggcgaaggcgcatacgtagctgcgggttcaacgattaccgacgatgtgccaggccgggctttgtctattgccagagcaagacaagtcaataaggaagactacgctgagaacatacacaaaaaataatcctaaatcggaggtttaccatgtctaaatatgaagacgacaatttgaagattttttctttaaactcaaatccgggtcttgcgaaggaaatcgcggatatcgtcggagttgagctgggaaagagttctgttaaacgctttagcgacggtgaagtccaaattaacattgaagaaagcatccgcggctgcgactgctatgtcatccaatcgactagcgcgccggtgaacgagcatatcatggagcttttgatcatggtggatgcgctgaaacgcgcgtcggcgaaaacgattaatatcgtgatgccttactacggctatgcccgtcaggaccgtaaagcgcgttcccgcgagccgatcacagccaaactcgtggcaaatctgctggaaaccgccggagctacccgtgtgattgcacttgaccttcacgcgccgcaaatccaaggtttctttgatataccgatcgatcatttaatgggtgttccgattttaggaaattattttgaagagaaaaatttcaaggatatcgtgattgtgtcccctgaccacggcggtgtgacccgtgcccgcaaattggcggaccgcttgaaagcgccgattgcgattatcgacaaacgccgacctaagccgaatgtagccgaggttatgaatatcatcgggcatatcgaaggaaaaacagccattttaattgatgatattattgatactgcaggaacgattacgctggcggccaatgcgctcgttgaaagcggcgcagaggaagtgtatgcatgctgtacacatccggttctttccggtccggcgatcgaaagaatcgacaattccaaaattaaagagctcgttgtgaccaacagcattgagcttcctgaagaaaagaaaatcgcgaaattcaagcagctttctgtcgcaccgcttctggcagaagcaattattcgtgtgcatgagaaacaatctgtcagcttcctgttcgattaatttgctgattctggtttaaagttttgtcgttatgggaatggttttagaaagaccaatctaacgataggatggtgctgaaaatggcaattttaaaagcggaagaaagaacggattccagacggtcttctttaagaagaattcggcaatccgggtatgtgccgggtgtcatttacggaagaaatctggagaacaaatccgttgcgttagacagtatcgagcttttaaaaatcttgcgcgctgagggcaaaaatacgattatcaacttggatataaacggtgaccaacactctgttatggtgactgagctgcagacggatccgttaaaagattcaatcgtacatgccgattttaaagtggttgatatggaagcggaaatggaggcgacggttcctgtaaaccttacgggtgaagcagagggcatcaaacagggcggtgttcttcagcagccgctttacgagctgtctgtcacagcaaagccgaagaacattccgcagacgatcgaggttgatatttccagtctcgaagtcaatgatgttctaaccgtcggcgatattccgaccaaaggcgattattcatacaaccatgagcctgatgaagttgttgcatccattcttcctcctcaaaagcaggaagaaacagaagccgaatcagctgctcaagacgttgaggaaccagaaaaaggcactgaagaggaaaaagaagaataaatacgtaagacgtaatccgcccgcggttacgtcttttgtgctagaatgaggggaaattaggatgctccccctcagtatgctgaggcagggttttgcttaagggaggatatagaataatgcttgtgtttgcaggattgggcaatccgggtaaaacatatgaaaatacgagacacaatgtaggttttatgacgattgacgagctctcgaaagagtggaacattccgcttgataaaacaaagttcaacggacaatacggaatcgggtttgtttccggcaaaaaggttctacttgttaagccgcttacatatatgaatttatcgggagaatgtttgaggccgcttttggactattacgagatccctgttgacaatttgaaagtgatttacgatgatttggatcttccgaccggaagaatccgtctgaggacgaaaggaagcgcaggaggccataacggcatcaaatcgacgattcagcatctgggaacaagtgagtttaaccggatcagaatcggaataggccgtccggtaaacggcatgaaagtcgtcgattatgtgcttggcgcttttacagatgaagaagagccggcgataaaagaggccgtcagacaatcggccaaggcctgtgaagcttctttggaaaaaccttttttagaagtcatgaatgaatttaacgcaaaggtataaggcaaaagggaacggaacatactagtcttaaaaagactcggtatggaggttcctttatggctttacattattattgccggcattgcggcgttaaagtcggaagtcttgaccattcttatgtaaacagtgaacagttaggctttaaccacttaacaaatgatgaaagaaacgatatgatttcttatatggataatggggatttacacgtgaagacgatatgtgaagattgtcaagaagcgcttgagcgaaacccggattatcaccaatatcattcatttattcaatagatagctttggtgtagagactagaccaaagcatttttctatttgaggaagagaggaggggctcatttgaacaatattcaatcctatataacaaaaagcgatgattttaaatccatcgtcaacggcttgaacgaagggctgaaggaacagctgcttgcggggctctccggatctgcccggtcgttatttacagccgctcttacaaaagaaacgagacggccggtatttttaattacgcataacctttatcaggctcaaaaaattacagatgatttaacagggctgataaaagatcagcctgtccttttatatcctgtcaacgaattgatttcttctgaaatagcggtggcaagccctgagctgcgctcgcaaaggcttgatgtcttaaataggcttgcaagcggtgaaacgcctatcgttgttgctccggcagcagccgtcagaagaatgctgcctcctgtcgaagtatggcaaaacagtcagattcacattgagacggggcgcgacattgacccggaacagctgctccagaagctcgttcaaatggggtatgagcgtacagatatggtggcggcgccaggcgaattcagcatacgcgggggcattatcgatgtctactctttgactgaagaaaatcctgtccggattgaattgtttgatacagaagttgactcgattcgtatattcaatacggatgatcagcgctcactggaaacgcacgatgaagtaacgatcggccctgcgaaggaactgatcgtgcgggatgaagacaggcaaagggcgcttgaacaaatcgatcaaggccttgccaacagccttaaaaagctgaagctcgataaacaaaaggaaattctcgaccaaaatatcgcggaagacaaagagcggctcaaggaagggcatatcggccaggaaatggtcaaatacctttcttatttctatgagaagcctgctagtttactagattatttcccgaaaaataccttgcttatactagatgaaatcagccgtattcatgaaatggaagaccagctgcaaaaggaagaggcagaatggattacgagcctgcttgaagaagggaaaatccttcatgatacatcgatgtcatttccttttcacagcctcatttcaaaacagtcccgcccgattttgtattactcgctgtttttaaggcatgtgctgcacaccagtccgcaaaacatcgtcaatgtttcaagcaagcaaatgcagagctttcacggacaaatgaatgtgctcaaaaatgagatcgaacggtttaaaaaatcgaaatatacgacggtttttctcggagacagcaaagagcgcgtcgaaaaactagcatctgtactgtccgactatgacatcgaagccgcacaggccgaccaggatgcagcgctcgcccaaggccagatttacattatggaaggcggtcttcaatccggttttgagcttccgatgatcaagctggccgttatcacggaggaagagctgtttaaaaagcgtgtcaaaaagcaggcgcgcaaacaaaaactgaccaatgccgaacggattaaaagctactcggagcttcagatcggcgattatgtcgttcatgtaaaccacggtatcggaaagtatttagggattgaaacgttggagatcaacggcattcataaggactacctgaatattcactaccagggaagcgacaagctttacgtaccggttgaccaaattgatcaggtgcaaaaatacgtcggttccgaaggtaaagagccgaagctttataaactcgggggaagcgaatggaaacgggttaagaaaaaggttgaaagctctgttcaggatatcgccgatgacttgatcaagctctatgccgaaagagaagcaagcaaaggctacgcgttttcacccgaccatgaaatgcagcgtgaatttgaagccgcatttccttatcaggagacagaggatcagctgagatcgatccatgagattaaaagagacatggaaaaagaaagaccgatggaccggctcctttgcggcgatgtgggctacggcaaaaccgaagtggcgatccgcgccgcttttaaggcgattgcagacggaaaacaggtcgcgatccttgtgccgactacgatcctcgcacagcagcactatgaaacgatattggagcgctttcaggactacccgattaatatcggtttgctcagccggttccggacgagaaaagaagcaaatgaaacgatcaagggcttgaaaaacggaacggtagacatcgtgatcggcactcacaggctgttgtccaaggatgtcgtatacaaagatcttggtctgcttatcatcgatgaagaacaaaggttcggtgtcacacataaggaaaaaattaaacgcattaaagcgaatgtcgacgttttgacgttaacggcaactccgatacctcgaacccttcatatgtccatgcttggtgtcagagatttgtcagtcattgaaacgcctccggaaaaccgcttcccggtacagacgtacgttgtcgaatacaacggggccttggtcagggaagcgatagaacgcgagctggccagaggcggtcaggtttacttcctgtacaaccgggtggaggatattgaaagaaaagcagaagaaatctcgatgcttgtacctgacgccaaggtgacgtacgcccatggaaagatgacagaaaacgaactcgaatcggtcatgctgaacttcttagagggagaatcggatgtactagtcagcacgacgattattgagacgggcgttgatattccaaacgtcaatactttgatcgtatttgacgcagacaagatggggctttcccagctgtaccagctgaggggccgcgtcggccgctcaaaccgtgtagcttacgcttattttacgtaccggaaggacaaagtcctaacggaagtggctgaaaaaaggcttcaggcgattaaagaatttacagaactcgggtcaggatttaaaatcgcgatgcgcgatttgacgatccgcggcgccggaaaccttttaggtgcgcagcagcacgggttcatcgattctgtcggtttcgatttatattcgcaaatgctcaaggaagcaatagaggcgcgcaagggagatgcaccgcaagctgaaaagtttgagccggaaatcgatttggagcttgacgcatatattccgcagacgtatgtgacagacggcaagcaaaaaatagatatgtataaacggtttagagcgatttcaaccattgaagaaaagagcgagcttcaagacgagatgatcgaccgcttcggcgaatatccgaaagaagtagaatatttattcgccatcgctgaggcgaaggtatatgccatcaaggaacgcgtcgagctgatcaaacaggataaagacgccgtcagactgacaattgacgaaaaagctagtgccgaaattgacggtcaaaaactgtttgaactcggcagcaagtacggcagacagatcggccttggaatggaagggaagaaattgaaaatctcgattcaagtgaaaaaccgaaaaccggaggaatggctggaaacgcttctcgacatattgaagggccttcaaaacgttaaaaagcaaacgatcgcttcatcataaaaatttgttgtttctcgcgtatattacatttgatgtgaaggatactaaaaccaatcaagagtggagagtgttacataagtacacagctctgtttatatccaccagatatatcatcaaatgaaagagaggcagcagagatgaaagcaactggtatcgtacgtcgaattgatgatttaggccgggtcgtgatcccgaaggaaatccgcagaactttgcgcattcgtgaaggagaccctttggaaatatttgtggaccgggatggggaggttattttaaaaaagtattctccgatcagcgagctcggcgactttgcaaaagagtatgcagatgcgctttatgacagcatgggccattccgtgctgatttgcgaccgggatgtgtatatcgcagtatccggggggtctaaaaaagactatttaaacaaatcgatcagcgacatggtcgaaaaggcgatggatcagcgcacttctgttttggacggagacgcgaagacgattcagcttattgatggtattgacgaagaggttgcttcttataccgtcggcccgattgttgcaaacggcgacccgatcggagcggttgtcattttttcaaaagaccagtcaatcggcgaagtggaacataaagcggttgaaactgccgccggctttttggcccggcaaatggaacaataggtctcattccttttattttgacattcctgctcaaacgagccggaatgccgaaagtgttttttctcagcttgaatcagcatcagcattggaacagcaccttttgggctgttcttttttaattcacacttgcaggaggggtgcaagccctgaatatggtataataagctcgtttcgtgcgctttttagaaagcgcattggaaggagcttaaaggaatggggtttttaaagggccaaagacaattgctttggcaaggcgcctttgtactttcattggcggggatattatcaaagatattaagcgctgtatatagagtgccttttcaaaatatagttggagatgtcggtttttatatttttcagcaggtgtacccgatgatcggaatatctgtcatgcttgccacctccgggttcccggtcatcatttcaaagttgctgaatgattacgggtccgcaaaccgggcaaagattctccgcgtgtctatgctctttttatcggctgtcggcctcggcttttttctactcttgtttgccggagctggagccatcgcagggtttatgggcgatctcgaccttgccggggtgatccgcgccgtgtcgttttcttatttgctgcttccgtttgtgtctttgctgagaggctattttcaaggaagcgaacggatgctgccgacggcactttctcaaattggagaacagacacttcgggttggggcgattcttgttttgacgtggtggctcgtcaaaagcggcttttccttatatgacgccggtgcaggggcggcctttggctctcttgtcggcggccttgcggcgtttttcattctcgccgtgttttgggccaagcgtgaaaagaaagccactgccgtccgaattgaggccgggacgggtgatattttaaaacagctgtgtctgtattcggttacgatttgtaccgccggcctcatgctgatcctcatccagctcgtcgacgcattgcacttgtattcattgctggccggacaaggaatgggcgaacttcaggcgaaacatacaaaaggagtgtatgacagggggcagccgcttttgcagctgggaaccgtttttgctgcgagcattgcgacggctcttgtcccgtcccttacgaaagcgaagaaaaagggagaaactgcagtgctggaggaaaagatccggtattcgctaaaaatgagctttgtcatcggcactggagcagccgccggtctgatttgtattttggagccggtcaatgtcatgctgtttaaaaacagcgatggaacggctgcgctccaaattttcagcgcgtcgattctctttgcatcgctggcgatgacgatgactgctgttttgcaaggactcggcaatacatgtcttccggctgtattcgtctgctgcggcattttggtgaaagccgtattgaacgagcttctgatccccggtttcggcatttccggcgctgcttttgctactatgatgtcatttgccgctgttgcggggctcaatttttttcagctgaaaagaaaaggctggattaagctgtcggaatacaggatagcgggtgttttgttgtcggctgtgatcatgtcggccgctctggcggtgtggctttttgcatttgaagcggccataccacataaaagcagatggatctcagcggcggaaagtcttagcgccgttttcgtcggcggcgttgtctttttgtccggtatcttcacattgcgcgtgttttcagaaaaagaacttgagcttgtgccttttggcagcaagctcctgacattaaaacgagaaaggggcggcaggcatggccggtaaaatcacggtagtcggccttggggcaggcgatatgaatcaattaaccctcggtgtatataaacggctcacacaagcggaggttctttatgtcaggacgaaagaccatccattaatagaagacctgaaaaaagaaatagcggagattcatttttttgatgaggtctatgaaaagcatgatcaattcgaagatgtttacgaggagatcgtagagcggctttttgaggaggcgaagcagggggatgtgctctatgccgttccaggccatccgttcgtcgctgaaaaaacggtccagcttttgcttgagaggcgtggggctcatcaggccgatgtcgtcgtcgagggaggccacagctttattgatgcgacgttaaatgctttgcagatcgatccgattgacgggtttcagtttgtcgatgccgtctggttttcagccgacgaagtcgagctccgtcatcatttgattatttgccaggtatatgatcaaatgacggcttcagaggtcaaactgacgttaatggaaaagcttcctgatgactatgaagtcgtcattgtaacagcggccggaagcagcatgcaagacattcggacagtgcctctttacgaattggacagaagcgtgggcatcaataatttaacgagcgtctatgtgccgcctgtcaaagacgaagagattctccaccaggaattttcgatgttccgcagtgtcatcagaaagctgcgcggaccggacggttgcccttgggaccgaaaacaaacccatgagtcgctcaaaaagtacttaatcgaggaatgctatgaggtgctagaggcgattgatgaagaagatcccgaccacttagtagaggagcttggcgatgtgatgctccaagttcttctgcatgcgcagatcggcgaggatgacggcctttttacaattgacgatgtgattcgcggcatcaccgcaaaaatgatcagaaggcatccgcacgtcttcggagaggtctctgttcgtgatgaggccgacgtcatggtaaactgggaagagatcaagaagcaggagaaacaagcggacgataaatccctcctcgacgatattccaaagccgcttcctgctttgtcaaaagcgaacaagcttcagaaaaaggcggcaaagaccgggttcgactggtcgaatgtccaggatatttgggataaagtccaggaggaaatgaaagaattttcttcagaaatttccgaagccgaacagcacagcaaaaaaatgaaagaagagttcggcgaccttttattcgcgctcgtcaatatcggccggttttataaaattgaaccggaagaagccctcgcgatgacaaacgccaagttttacagaaggttcacatatattgaacaatctgcaaagcgcatgggcaaggatctggaaagtatgacgcttgaagaaatggacgaactgtggaatgaagcgaaaggcattgaaaggagctgacaagcgatgagactcgacaaatttctcaaagtatcaaggctgattaaaagacggacgcttgcaaaagaagtggctgaccagggaagaatttcgatcaatggccagcaggcgaaagcaagctctgttgtcaaagcgggggacgagcttgcggtgcgtttcggccaaaaacttgtaaccgtcaaagtcaatgaattgaaggatacgacaaaaaaagaagaagccgctgatatgtataccgttctcaaagaggagaagctgggaggagaataggcttgttctaaaaaaatcccccgtctcatacaatgcagtatcgaatctttagtatgaggatatgggggatgaatcgatgaatgtatattatgatcagcacaacccttccggcggggcatctggtcctgaacataatgtgacgatgaagggccgcaagcttctggatatatccggtgtcaagcaggtcgagagctttgacaacgaggaatttttacttgagacggtaatgggcatgcttgcagtcagaggcgaaaacctgcagatgaagaatctcgatgtggaaaaaggcgttgtctccatcaagggaagagtgcttgatctcgtctatttggatgagcagcagggggagaaagctaaaggattttttagcaagttgtttaaatgacgctgaccacacagttctatacgatgctggccatggccggaatgggggcatggcttggcgcttcccttgacacctatacccgttttgtcgttcgctcgaaaacagcaaggtggctgttgtttctccatgactttttgttttgggtagtacaaggcctcctttttttctatgttttgctgagcgtgaatgaaggggaattccgaatttatatctttctggcggtcatgcttggttttgccgcttatcagagcctttttaagcaggtctatatcaagcttttggaatggatgatttccttttttatattcatctccaggctgggctcaaagatgatgcggatgatggtgtttcggcctgttgtatggacgtttcaagccattttagccatcattctctttacaatgagaaatatctatgttctttttcgtttttttgcggtatgtttatataagatattaaaatttgcaggatacccgatttattttatactatatcaatgctgcaggcttcttcccgccccggttcggggattgttgagacgctttttgcaaaaaggagcaggatttttcgaaaaggggaagaaactattcataacaattaaggcaaaacttttaaaaaaatgaagggaggccgtctggaatgaatgatcccacaagacgcaacatatcgcaaatacagaacgaatacaaagagcagatggagcgaaaacagcagcagctgaaaagaaaaagacgcggtctatacagacggttgatggttttcggcgccgttgtgctgctgtcggcgattgtgattgtcagctcgctctggtcgcagacttcggatatcagcgcgaagcaagagaagaaagctgagcttttgaaacaattggaacagctggaagcaaaaaaatcggatttgaaagatgagattgtgaaattaaaggacgaggactacgttgcagagcttgccagaaaggattactacctctcaaaggatggcgaaatcatcttcaagtttgaagataagagcaagtagccttgttgacacttaattttttctttatgtataattaaacaaatgatcttttttaagtctaaggaggagcactttttttatgtcgattgaagttggcagcaagttgcaagggaaagtaacaggtattacaaatttcggagcgtttgttgaactgcctggaggatcaacaggtcttgttcatatcagcgaagtagccgataactacgtgaaggacattaatgatcatctgaaggtcggtgatcaagtagaagttaaagttattaatgttgagaaagatgggaaaatcggcttatcgatcaaaaaggctgtagaccgtcctcaatcatcaagacctgcgagacctaaaaatgatttccgctctaaagaaacgtttgaacagaaaatgaataagtttttaaaagacagtgaagatcgcttatcgtctctaaaacgcaacacggaatcaaaacgtggagggcgcggagcaagaagaggttaacttgctgctttctatataaacgaaaggcattcgtcttatcccaacggatgcctttttattttctaataaaatttttattaaaatttctattgacggatagggcaatcctttgtattatagaacttgtgctttaaaagaaatcaacaacatggcggtgtagctcagctggctagagcgtacggttcatacccgtgaggtcgggggttcgatcccctccgccgctacttatatgaaggcccgttggtcaagtggttaagacaccgccctttcacggcggtaacacgggttcgaatcccgtacgggtcattccggaaaccggcttcttctgaagccggttttttgctgcataaaaatatgcaaaataacgggaatggactcgacttatcaagagtgattgaagcatgctacaaaaagcgtcgaacagttctttgaattcgttaccttcttttgacaaaatcctatttcatctttcgctataatggcaagcaacgaataaacgagtgggagatgagagcatggaaaaagcggaaagaagagtgaacagcccaatagctggacctgctgttcaaaaattgtattcatggtttggcagcatgacgaagcttatgatgcagcatttatattccctctttttttataaagggctgatctatatggtcatcggttttttattgggacgagccttcattctgtcagaggtcattccctttgctcttccatttttcggagcgatgcttttaatcaaaaaagataaagctttccttgcatgcctggcgcttcttgccggagctctgagcatatcgcctcagcattcgctgttcgagcttgcggctctgtttgcatttgcgatatgttcaaaaatgacgtcccttattataaaagaccgtgtcagaacgctgcctgtcgtcgtctttttggcgatggctgtgacaagatgcggattcgtatatgccgaatacggaacggtttcaggttatcactatattatggctttcgttgaagccggattatcgtttatcctcacattgatttttctgcaaagcctgccgattgtcacatcaaagcgggcgaaacagtcgctgaaaattgaagagatcatttgttttatgattttaatcgcttccgttctcacgggcttgacaggcgtttcatttcaaggcatgcaggctgaactgatattggcccgttatgtcgtgctcgctttcgcgttcatcggaggcgcaagcatcggctgtacagtcggggttgtgaccgggctgattctcagcctctcaaacatcggcaatttatatcagatgagcctgctggctttctcaggccttctcggcggtttgctaaaagaaggaaaaaagttcggcgcagcggtcggcttattgattggatctctattgatttctctgtacggagaaggttcggctgaattagtgccgacgctttatgaatctctgattgcaatcggcctgttccttttaacccctcagtcgattacgaaaaaagtggccaagtatatacctggaacgactgagcacgcccaggaacagcagcagtatgcaaggaaaatccgcgatgtcaccgcccaaaaagtcgatcagttttcgaacgtttttcacgctttatccgaaagcttcgctaccttttatcattcagctccggacgatgaaggaaaagaaaaagagatcgatctgtttttgagcacggtgacagaacattcctgtcagtcatgctataagaaaaacaagtgctgggttcagaactttgataaaacatatgatttgatgaaacgggttatgcaggaaacggaagaaaagcaatattttaaaaaccgcaagctgaaaaaggagtttcatcagcactgctccaaatcaaagcaagtagaagcgctgattgaagacgagctgactcattttagggcgaaccagacattaaaacaaaaggtgcatgacagcagacgtctcgttgcagagcagcttctcggcgtttctcaggttatggcggacttttctcgggaaataaaaagggaaagggagcagcattttattcaagaagagcaaattcgggatgcgctgcagcacttcggcatcgagattcagcaagtcgaaatatacagccttgagcagggaaacatcgatattgaaatgagtatcccgtattgcaacggccatggagagtgtgaaaaaatcatcgctccgatgctgtccgatattttggaagaacaaattatcgtcaaagcagaacagtgcgccggccatccgaatggatattgtcatgttgccttcggttcggcgaagtcatacagggtggtgacaggagccgcgcatgcagcaaaaggcggagggcttgtctccggcgacagctacaatatgatggagctcggcaccggcaaatatgccgccgccattagcgatggtatgggaaatggcgcaagggcccattttgaaagcaatgagacgatcaagctgctggaaaagattcttcagtcgggcatcgacgaaaaagtggcgattaaaacgattaacagcattctttcattaaggacaacagatgaaatttattcgacattggatttatcggtcatcgatcttcaggatgcgagctgcaagtttttgaaaatcggctccaccccgagctttattaaaagaggcgatcaaattatcaaagtgcaggccagcaatctgccgatcggcatcattacagaattcgatgtcgatgttgtcagcgagcaattaaaagcgggagaccttttgatcatgatgagcgacggaatctttgaagggccgagacatgtggaaaatcatgatctgtggatgaagcgcaaattgaaatcgctgaaaaccgaggagccgcaggaaatcgccgacttaatcatggaagaagtgatccggacaaggtcgggtctgattgaggacgacatgacggtgattgtcatcaagctggaccataatacgccaaagtgggcctccattccggcgccggcttttttccaaaagaatcaagagatttcttagcattcgtataaatcaaatttcttctggcgatgatggaactaaatcaagatatctttgtccaggaggaataaaacgatgaaaaaggggcatttgaatcaaatcctgcttttgacggacggctgttcaaaccgcggcgaagacccgcaggccatggctgcctttgcgaaagagcagggaattaccgtgaatgtgattgggattatggacgagcatgaaatggatcaggaggcgatgaaagaagtcgaagggatcgctctcgcaggcggaggagttcaccaggtggtttacacgtcgcagctgtcgcagaccgttcaaatggtgacaaaaaaggcgatgacgcaaacccttcaaggcgtggtcaacagtgagctcaaacaaattctcggcaagcataccgaaatggatgaactgcctcctgataaacgcggtgaagtcatggaagtcgttgacgagcttggtgagaccgtgcatcttcatgtactggttcttgtcgatacaagcgcaagcatgaatccgaagcttccgaccgttaaagaagcgttgatagatctttccatcagtctcaattcaagaatcggcgaaaacgaatttgcgatgcttatatttcccgggaaaaaacaagaggtcgaacttgtgctcgattggaccccgaagtttgaatctctttcttcaatattttccaagctttcagccggtggcattacaccgacaggacccgcaatacgagaggcgattcagcattttaacaaaatcggctcaagaaggagaatgttagaagacgatgaaaaacgcttcgacgagtttggcggctagtctaaagccgggtgcagccgttgttggaaagtggaacaatcattcctacaagatcatcagacagcttggaaaaggggcaaatggggttgtttatctggccgattcaagaaagggccgggttgcattaaaagtgagcgatgacagcctgtccattacctcggaagtgaatgttctgaaatctttctcaaaggcccaggcaaaagcaatggggccttctttttttgatgtggatgacatgatggttacaggcaccggcaaaaaactttcattttatgtcatggaatatattgaaggtccgcttcttttaagatatgtaaacgaaaaaggcgaggaatggactccggtgctgatcagccagcttctctcaagcctgtcggcgattcatcgcgaaggatgggtgtttggagatttaaagcccgagaatttaatcgtgacgggtcctccgccgcaaatccgctgcattgatgtgggcgggacgacaaaagagggccgggcaattaaggaatatacggagttttttgacagaggctattgggaattcggcactcgtaaggctgagccgtcgtatgacctgttttcagtcgccatgattatggtgaactgtgcggtgaaaaaagaattcaagaagacagcaaggcctcaggagcagctcatgtcagtcattgacggacatccgtttttaaaacggtataaaccggttcttgcttctgctttaaaaggaagctatcgaacagctgatgaaatgaagggagatcttctggaaatcggccggccgccacgaatgcaaagcagccgccagtcgagaacagcccgttcctcatcggcatctgccccgtcgcaaggcctgcggcataagcaggggacgcctcagcagcaaaggttaaggagcgggcgcagaaagcaaagaaacccttctaaatccggcggtgtttttgaaacgctgttgatcgtcgtaagcgttcttgccctttactttgcgtatatcgttctcttttttatttagctgtgcattctcggcggatagctcttctttgcagggaccgattgaaagtgttaggatatttatatcttttgaaatacaccctgctcttagtgggaggacattgtgaaaagtattgaagatttcatgaaaaaatacgaactgtcatttgatggagtgacgctgattgcaggtgtctccggcggacctgattcgatggcgcttttgcatgctctgcaccatacggttcccgcttctgcaacgctgattgccgcacacgtcgatcatatgttcagaggcgaagagtccgagcgtgatatgcggttcgttcaggactactgcgaggcggaaggcatacaatgcgaggcggtgcaaatcgatgtcctggcatttgccgctgaaaacaatctgaataaacaggctgctgcgagagaatgccggtatgcgttttttcaagagttaatgaaaaggcaccgggccgaatacctggttctgggtcatcatggagatgatcaggtggagacgatgctgatgaagatggcaaaaggcactgtcggaatcgggcttgccggaattcagccaaagcgccgttttgacagcggctggctgctcaggccgtttctgaggctgtcaaaggatgatcttttggcttactgcaaagagaatcgaataccgtttagaaccgatccgagcaacagtgaggatgattacaccaggaaccggttcaggcaccatgttctcccttttctgaagaaagagtcggaagatgtccataaaaggtttcaatccgtcagtgaattcctgacagaagacgaattatacttacaggcattaacgaaagacaaaatgaatacagtaatcacaagcaagtcaagttcaggcgtggaaatcagcatcgaacgacttcttgcgctccctatgcctttacaaagaaggggagttcatctaatattaaactatctttatgaaaacgttccatcagcgttttcagcccatcatattcaagtgtttctggattggatttcacaagacggaccatccggttcccttgattttccgaatgggttaaaagtcgcaaaatcttatcatacatgtttgtttacatttcagcgtttacaatgtgaaaatgtttcctatcattatgaaataagcggggcaggcgaagaagaactgatacttcccggcggctcctcccttcatgtgagcggacccggttcaacccggaagctgcaaggaaatgatgtttttgcaacaagtcccaagcaggttcagtttcccctttacgtacggacaaggcaaaacggagaccgagtcaaacttaaagggatgaacggctcaaaaaaggttaaagatatatttattgatgaaaaagtgcctctttcaaaaagagacagctggcccattgtaacagacgcggttggaaacattatctggatacctggtctgaaaaaaaccatttttgaggaacttgatgttacaaacaacgatcgcattgtattacaatatagacagcatgaaaagtgtagggggctagcaaagaatgaaacaggatattgaaaatatcttgatctcggaagaagagatccaaaagaaagtcaaggagctgggcgcgactctgacagaagagtacagcggcaagtttccgctggcaatcggtgtgttaaaaggagccatgccgtttatggctgatcttttaaagcatattgatacatatctggaaatggatttcatggatgtatcaagctacggcagttccacggtttcttccggagaggtgaaaatcataaaggatttggacacatctgtagagggccgtgacatcttaattattgaggatatcatcgacagtgggctgaccttgagttatcttgtagagcttttccgataccgcaaagcaaaatcgattaagatcgtaacccttcttgataaaccaagcggacgaaaagcggatatcaaagcggattacgtcggctttgaagttcccgatgctttcgttgtcggatacggtctcgattatgctgaacgctatcgtaatcttccgtacatcggagtgctgaaacctgcggtttatgagagctgatacgggcttgtcagcgaaagggatatctgttgtattggaacgattttctatgatactattgaacatagttgtgcttactgtgggaggaggtaaggaatgaatcgggtcttccgtaataccattttttatttacttattttattagttgtgatcggagttgtgagctacttccaaaccgcaaatccgaaaacagaaaatatgacgtatagtgactttgtttcaaacctagaaaacgggaaggttgaaaatgtctccatccagcctgtcaggggtgtgtacgaggttcgggggcagctgacgacctatgagaaagatcagtatttcctgacccatgttcctgaaggaaaaggggcagatcaaatcattgatcaagtgaaaaaaacgaagatacaaatagaacctgcgcaagaagcaaatggatggatgacgttctttaccaccatcatcccttttgttattatcttcattcttttcttcttcctgcttaatcaggctcaaggcggcggcagccgtgttatgaactttggaaaaagcaaggcgaagctctatacagaagaaaagaaacgcgtcaaattcaaagatgtggcaggagcggatgaagaaaagcaagagcttgtggaagtcgttgatttcctcaaggatccccgcaaattcgccgagctcggtgcaagaattccgaaaggcgtgcttttggtcggacctccgggtaccggtaaaacattgctggcgaaagcatgtgccggtgaagcaggggtgcctttcttcagcatcagcggatctgacttcgttgaaatgttcgtcggggttggtgcatcacgtgttcgcgacttgtttgaaaacgccaagaaaaatgcgccgtgtctgattttcatcgatgagattgatgctgtcggacgccagcggggagcaggccttggcggaggtcacgatgaacgtgaacagacgctcaaccagcttcttgttgaaatggacggattcagcgccaatgaaggaatcatcatcatcgctgcgacaaaccgcgccgatattttagaccctgcattgctgcgccctggacgttttgaccgtcaaattactgttgaccgcccggatgtcaaaggccgtgaagctgtacttcaagtacacgcaagaaacaagcctcttgatgaatccgtaaacttaaaagcgatcgcgatgcggacgccagggttctcgggtgcagaccttgaaaaccttttaaatgaagcggctcttgtggcggcgcgtcaagataagaaaaagatcgatatgcgagacatcgatgaagcgacagaccgcgtcatcgccggacctgcaaagaaaagcagggtgatctcgaaaaaagaacgcaatatcgtggcttatcacgaggcgggacacaccgttatcggacttgtcttggatgaggcggatatggtgcataaagtaacgattgtaccgcgcggccaagcaggcggatatgccgtcatgcttcctaaggaagaccgttatttccaaaccaaacccgaacttctcgataagattgtcggcttgcttggaggccgtgtagctgaggaaatcatcttcggcgaggtcagcacgggcgcccataatgacttccagcgcgctacaggcattgccagacgaatggtaaccgaattcggtatgtctgaaaagctcggtcctcttcaattcggacaatcgcaaggcgggcaagtattcttgggtcgagatttcaacaatgaccaaaactacagcgacgcgattgcgtatgaaatcgataaagaaatccagcgcttcattaaggaatgttatgaacgtgcaaaaacaatccttactgaaaatcgcgacaaacttgagctgatcgctcaaacattgctggaagttgaaacgctcgacgctgagcaaatcaagcatttgtctgagcacggaagacttcctgatcgaacatactctgatgatcaggagaagacagatgatgtgaaagtcaacatcaataaacgagatgacgaagagaaaaacgaggatgaaaaagaataatgacgctttttcgtctcttcaggaaaactgccaagctctgctttcggcagttttctttttttatggctgaaaaaatccgctttggaaaatctttctcctcaccggtttgattcgtttacaaacagaatcggcatcgtgtattgtatgatggtagaatgttttatgtccaagtaagagaaactagtcaaaagtggtgatcagaatgttgcttgttatagatgtaggaaatacaaacaccgtccttggcatctaccacgaaggagagctcgaatatcattggcggattgagacaagccgccataaaacggaagacgaattcggcatgcttcttcgttctttatttgattatgtcggactgatgtttgaccagatcgaggggattattatttcatcagttgtaccaccgatcatgttctccctcgaaagaatgtgtatcaaatattttcagatcgagcctcagattgtcggtccgggaatgaaaacaggattaaacataaaatacgataatccgaaagaagtcggagcagaccgcattgtaaacgcagtagccgctattcatctctatggcagccccttgattgtcgttgattttggaaccgctacgacgtactgttacattaatgagcgcaaggaatatatgggtggtgcgatcgcgccgggcatcacgatttcaactgaagcgctttattcaagagctgccaagcttcccagaattgaaattgcacggcctgatcatatagtcggcaaaagtacggtcagcgcgatgcagtccggaattctttacggctatgtcggacaggttgaaggcattgtcaaacggatgaaatggcagtccaagaaaaatccgaaagtcatagcgacgggcggccttgcttccttgattgcagacgaatcggactgcatcgatattgttgacccgttccttacgttgaaggggctagagctcatttatgaacggaatcgtgttgaaagtgtataggaggatgaggtatggattatttagtgaaagccattgcatatgacggcaaagtgagggcatatgcagcgaatacaacagaaacgattcatgaagcccaaagaaggcataacacatggcctaccgcttccgccgctttaggaagaacgatgacggcggctgtcatgctcggcgccatgctgaaaggcgaagacaagctcaccgttaagattgaaggaggcggaccgatcggcgcgattgtcgctgacggaaatgcaaaaggagacgtcaggggatacgtgtccaatccgcacgttcatttcgacttaaatgaacacggcaaacttgacgtcagaagagccgtcggtacgtcaggaacgctaagcgtagtaaaagatctcggtctccgcgatttatttacaggccaggttgagatcgtttccggagaaatcggcgaggattttacttattatctcgtgtcctctgaacaggttccttcttcggtgggtgtaggggtgctcgtcaaccccgacaatacgattttagctgcaggcggatttatcctgcagctgctgccgggaacggacgacgaaaccatcacgaagcttgaaacaaacctttcacaagtggagccaatttcaaagctgattcagaaaggtttgacacctgaggaagtgctggctgcggtattgggagaagaaccggaagtactggaaaccgttcctgtccgatttacatgcaattgttcaaaagaacgtttcgcaagaggcatcatcggtcttggcaaggatgaaattcaacagatgattgatgaagatggccaagccgaggctcaatgccatttttgcaatgaaacgtatctgtttacaaaggaagagcttgaagcgcttcgagatgaaatataagcccgctatccagtagcgggtcttttccaatggggaaaggggagacaccatattgaaatcgagaacactttggccgattattttaggtgcgatcttcgtcaattgcattgtgatcgcgtatgttctgacgaaagcgcagaccgcttcttcatcgtcagctcaagaagtcattgcccatatcggaaaaaacggcatcacgcgtgaagaatggctgagcgaaatggaagagcgctacggaaaatcaacccttgaagatatgatcaacgaccgcgtagttacccaaatggccgaaaaaaacaagatcaaagtgtctgatgatgacattgaaagagaatttctgctgattaaagctgtatacaattccttctacgaagacgaaaacacaacagaaaaagaatggaaagagcagatcaagcataatattcttcttgaagagctcctgacaaaagacattgtcatttctgacagcgaattgaagtcattctataacaaaaataaggacttatataaattcgatgattcttatcgcctcaagcatatcgttgtcaaagataaagatgaagcagaacaagttcttaaagaactgaaggaagggtccagttttgaagcggccgcagccgaacactcgactgaccggtatacggctccttacggcggcgacctcggtttcgtcaatgatcagcatgaaaacgttccggccgaatatttggagaaagctgaacaactaaaggaaaatcaatgggtggatgaaccgattaaaacaagccagggctatgcgattatccagctcaaagaaaagctcccggggcaagctttcacttacagcgaagtgaaaaatcaaatcagaaggcagatcgcgatggatcaattaggcgacaaagcttctgtcaagacgctctggaaagatgcgaaagtgtcttggttttatgacgataaaaaataaagattgacaaaatattttgatattgataaattagatataatcccaataaaattactcggaaattgaggtgttcaaatggttcgcgttgcaaactctgtttatgacttaatcggaaatacacctgtcgttaaattaaatcgactagttgatgaagacagtgctgaagtatatgtgaaactggagtatatgaaccctggaagcagcgtaaaagaccggattgcgcttgctatgatagaagacgctgaagagaaaggccttctgaaagaaggagatacactgattgaaccgacaagcggaaatacaggaatcggacttgccatggtcgctgcagcgaaaggcatcaaagcgattcttgttatgcctgatacaatgagttctgagcgccgcaaccttctgcgtgcatatggagctgagcttgtgctgactccaggtgctgagggaatgaaaggcgcgattaaaaaagcggaagaactggctgaggaacacggctattttatgcctcagcaatttaacaaccctgcgaacgcagaagttcaccgccgcacgacgggaaaagaaatcgctgaacaattcggagacggtttagatgctttcattgcaggtatcggaaccggcggaacgataacgggtgccggagaagttctgaaagaaaaaaatccgtccatcaagattttcgcggtggaaccgactgattctcctgttctttccggaggaaaaccagggccgcacaaaattcagggaatcggagcgggattcgttccgaaaatcttgaatacggaaatttacgatgaaatcatcacagtgaaaaacgaagaagcttttgaatttgcccgtaaagcggcgagagaggaaggaattctcggaggaatttcttcaggcgcagccatctgtgctgctcttcaagttgctaaaaagcttggaaaaggcaaaaaagttctcgctgtgcttcctagtaacggagagagatacttaagcacgcctctttaccaatttgaataggctccagctgaaacaggaggctgccgacgatgtcggcggccttttgtttgtcatggagcgcagcccttttaaaagctcggtgtccttgagtgaacatgctcaagggcttttttctgtattggaaatgaaattctcttttcctagaaaaaagatatgcattacaataaggacattagactaacggcagaggaatgatatgatgagacaacgaaggcctgtagccagagcgttcccattttccaatcaacagtttttgcagcaatatgaaagcctatcgaaaggaaaagaataccacgttctgctggaaagcgcgagaggcggagaatacagcatagccggactcgaccctgtcgcaatagcgaaagggaaagacggtatcacgacgattcaatataaaggggacgtcatattcaaagagggggatccgtttctgcagttttctcaatggtttgaaacgctgaaaacggagacagttgcagattttcccgactttcagggcggggctgtcggttttcttagctatgactatgcccggtatattgagaaattcaaaatcctgtctattgatgatctgcaaacgccggatttattctttctcgtatttgatgatatagccgtctatgaccatgagcagcagcagctttgggtgattacccacactgatgaagaaacgccggccgctgcggaagagaaattggacaggcttgagcaaatgtggaagacggaacatccgaaggccgctggaggtcatcagccgaatgataacaaaggcccggcattcgcggcctcatttacagaagccggcttttctcaggctgttgagaaagtgaagcaatacatcgcaagcggtgacgtatttcaggtgaatctttctgttcgccagtcggagcgcctttctgcgcctccttatgaggtgtataagatgttaagagaaatcaacccttcgccgtacatggcctacttggaaaccccggattttcaaatcatctgcgggtcgcctgaactgctcattaagaaaaagggcaccaggcttgaaacaaggccgattgccggaacgcgatcccgcggggcggatgaagcggaggatgaagcgctcgcgaacgaattgatcatgaatgaaaaagagcgcgccgaacatgtgatgctcgttgatttagagcgtaatgacctcggcagggtctccaagtacggttcggtccgggtcgatgaattcatggtgattgagaagtattcccacgtcatgcatattgtctcaaatgtgtgcggtgaactaagggatgaatgcgatgccgttgatgtcatccatgccgtgtttcccggaggtacgatcaccggagcgccgaaagtcagaacgatggaaattattgaggagcttgagccaacgagacgggggctttatactggttctatagggtggttcggatataatcaggatatgcactttaatatcgtcatccgaacgatttatgtgaaagcgggccaggcgttcatgcagtcgggagcgggaatcgtcatcgattcaaatcctaggcatgaatataaagagtcaattaaaaagaccctggcgatgaaaaaggcgctgcagttgagtgaagaagagaaaaaagagcagaggagagctgagatatgattctaatgatcgacaattacgattcgtttacgtacaacttggttcagtatttaggcgagcttggcgaggagttggtcgtcaagcggaacgatgagatcacccttcaggaaatagaggacatgtcgcctgactttttgatgatttctcccgggccttgcagtccggatgaggccgggatcagccttgaagcgatccgccattttgccgggaaaataccgattttcggggtttgcctcggacaccagtcgatcgcccaggttttcggcggcgatgtcgtcagggcagagcggctaatgcatgggaaaacttccgagatttcgcacgacgggctgacggtttttaaaggcctggaacatccgctcacggccacgaggtatcattctttgatcgtcaaaccggatacactgcccgattgttttgagacatcggcttggacggaagaaggggagattatggccatcaggcataaagaactgccggttgaaggcgttcagttccatccagagtcgattatgaccgcttacggaaaagagatgctgaagaattttattgagacttaccgaaagaaagtgaacgcatgatcatttacctgaacggtcaatatgtaaaggaggaggaagcaagactttctccttttgaccatggttttttatacggagtcggggtattcgaaacgttccggctttatgaagggaagcccttccttttagactggcatatggacagattgaacaacgctttggaacagctgaaaattgagcttgagctgacaaaaagcgaagtgcttgtcattcttgacaggctgcttcagttgaatcagccgcagaatctggatgcgagggtccggctaaatatatccgccggtcccggcggccccggcctttttcctgattcatacaaaaatcccggcgtcatggtgatgatgaatccttttcagcctgcatccgttccggctgaaaaggagggcgtcatcttgcaggtccgccgcaatacgccagagggtccgttccgcttgaaatcgcatcactttttaaataatttgtacggaaaaagggagctcggacatggcgcggccaaagaagggatttttcttaccgaaggcggagctgtagctgaaggaattatttccaacgttttttggcggaaaggcagctgtgtgtatacaccttctcttgataccggcatattaggcggtgtcacacgccgctacgtcatcgagcgccttgcagatatgggaatcgaagtcatagagggggtataccccttggaagagcttctctttgcggacgaagcatggatgaccaattccgttcaggaaatcgttccattccggagaatcggcagcactgaatttccgggaaaggatggaaatttgtcgaaacgtctgcaagaggcatacactaatgataggaaagcagcaaaagaatatttgagttaaagggtgaaggatatggcgcttcaaacagcggtgcgttcaaagcaactgatcgcaaagcaatacacgttgtcttatgaagataaaacattgatcatgggaattttaaatgtgacgcccgattctttttcagacggcggaaaatataacagcatcgatcgcgccgtcattcatgcaaaacaaatgatcgaagacggcgcccatatccttgatatcggaggagaatcgacgaggccgggggcggaaaaggtttctcttgatgaagagctgtcaagagtcatacctgtaattgaaaaacttgttcaggaaatcgacgtcccgatttccgttgacacttataaagcgcaagtggcagatgaagccattaaggccggtgcagccatcatcaatgatgtctggggagcaaaagcagatcctgacatggcccgagttgcggccgctcataatgtgccgattatcttgatgcataaccgcgaggaacggaattataaggatttgatcccggacatgctgtctgatttgatggaatgtgtgagcattgcaaaatcagcaggcgttcaggatcatcacatcgtacttgatcccggcatcggctttgccaaaacgtatcatgacaatttggcggtcatgaatcagctcgagaagttcagcgaaccgggatacccggttttattggggacgtcacgaaaaaaatttatcggccgagtcctggatctgccgcctgaagaaagagcggaaggcacgggggcgacagtatgcctcggtattcaaaaggggtgcgatatcgtcagggtgcatgacgtcaagcaaatctccaggatggcaaaaatgatggatgccatgattgataaaggaggcgtttatcatcgataaagtgcatgtagagggcatggagttttacggatatcacggtgttttcaaagaagaaaacaaactcggccagagattccgcgttgatctgacagcatttctagatttaagcgaagccgggaaaacggataatattgaggccaccattaattatgcagagctgtataagctgtgcaaagaggttgtggagggagagccggtcaaccttgtggagaccctcgcggaaacgattgccgcacaagtgctggagaattttgaagcggttcaggaatgtacggttaaagtcgtcaagcctgatcctcctatacctggtcactataaatcggtggccatcgagatgacgagaaagcgaaaatgaacaacacggcatatatagcgctcggctcgaatatcggccggcgggaagaatatttaaaaaaagctgtctctctcctccatcaacatccgtctgtagaggtgacagacatctcgtcaatttacgaaactgatcctgtcggttatacagaccaagatctatttttaaacatggctgcagctgttaaaacatctctttcaccgtttgaattgctcgatttgactcagcgtattgaaaaagaactcggccgcaaacgcgacattagatgggggccgaggactgcagaccttgacattttgttgtataatcgtgaaaatattgagacagagcaacttatcgttcctcatcctagaatgcatgaacgtttgtttgtactcatcccgctgctggagatttatccggatcttgagggagctgtcaatcatgcaaaaaatcaagaaggtgtaagagtatggaagcagaaatctggggtagacgaattcgtgcatatcgaaagctgaagggttatactcaagaagggtttgccaaagcattgggtatatccgtttctgtgcttggtgaagtagaacgcgggaatcgtatgccgacggagagcatgctcagggatgtagccaatactttaaatataacagtggaggaactatctccatcagaagaataagaaaggaggactaaaaatgtttaaaatcggtgatatagaattaaaaaacagggttgtgctcgcgccgatggccggtgtctgcaactcagccttccgcttgacggttaaggaattcggagcgggtttggtctgcgccgaaatggtcagcgataaggcgatcctttacaataatgcgaaaacgatgggaatgctttatatcgatgaacgtgaaaaaccgctcagcctgcagatcttcggcggagaaaaagaaacgcttgtcgaagcggcgaagtttgttgaccaaaacacaactgcggatattattgatataaacatgggatgtccagtgccaaagatcacaaaatgtgatgcaggagccaaatggctgcttgatccgaataaaatttatgaaatggtttcagctgtcgtggaggctgttgacaagcctgtgaccgtgaaaatgagaatgggttgggacgaagaccatatctttgctgttgagaatgcgagagctgtagaacgagcaggcggaaaagcggtcgctcttcacggacggacccgcgtgcaaatgtacgaaggaacggcgaactgggatattatcaaagaagtgaagcagtccgtttcaatccctgtaatcggaaacggtgatgtcaaaactccgcaagatgcaaaacgcatgcttgatgaaacaggggtggacggcgtcatgatcggccgtgcagcgctgggtaacccgtggatgatttaccgtacggttcactatttggaaacaggcgaattgaaagatgagccgaaagtgcgtgagaaaatttctgtctgcaaacttcaccttgaccgattaatcgggctgaaaggcgaaaatgttgcggttcgcgaaatgagaaagcacgcagcctggtatctaaaaggcataagaggaaacgcaaaggtccggaatgaaatcaaccattgcgaaacgagagatgagctcgttcagcttttagacgcgtttacgattgaagccgaggcaaaagagcttcaggatgcaaaagtaggataaatccgacctctgctcactgccagttttcactggcagtttttctgcttttttcctgaaagactaaaagtaacggagtgatatatgatgagccatgaagagcataaccatgaagaattaaacgaccagctgcaagtcagacgcgataaaatgaatcagttgagagaaagcggaaaagatcctttcggacagcgttttgatcgcacccatcaatcaactgatctcattgagtcgtataatgaattctcaaaagaagaattagaggaaaaagcaattgaagtaacgattgccggccggatgatgacaaagcgcggaaaagggaaagcgggattcgcgcatattcaggatttaaagggccagattcagatctatgtcagaaaagacagtgtcggtgaagagcagtacgaatggtttaaaagctctgacctcggggacatcgtcggcgttacaggcgtcatgtttaaaacgaatgtaggcgaattgtctgtaaaagcaacatcttttgatttattgacaaaagcccttcgtccgcttccggacaaatatcatggattaaaggacatcgagcagcgctaccgtcagcgttatttggatttgatcgtaaatccggaaagcaaaaatacgtttattacacgaagcaaaatcattcaatccatgagaagatacttagatgaccacggatacttagaagttgaaacgcctacgatgcacgcgattccgggtggcgcatctgcccgtccgttcattacacatcataatgcgctggatatgccgctttacatgaggatcgctatcgagctccatttgaaaaggctgatcgtcggcgggttggaaaaagtctatgaaatcggacgtgtattccgaaatgaaggggtctccacacggcacaatcctgaatttacgatgatcgaactttacgaagcttatgctgactataaggatattatgagattgacggaaaatctcattgctcatattgcacaagaagtgctcggcactacgaccgttcaatatggagattatgaagtcgacctcaagcctgaatggaagagactccatatggtcgatgctgttaaagaagccaccggtgtagacttctggaaagaagtatcggtagaagaagcaagagcatatgccaaagaacacggaattgaaatttctgaaggcatgtcagttggacatatcattaatgaattcttcgagcaaaaagttgaagaaacgttgattcagcctacttttatatacggacaccctgtggagatttctcctctggctaagaaaaatcctgaagaccctcgatttacggaccgttttgagctgtttatcgtgggccgtgagcacgcgaatgcatttactgaattaaatgatcctatcgaccaaaaagaacgctttgaagcgcaattaaaagaacgtgaagaaggaaacgatgaagcgcatatgatggatgaagactttgtcgaagcgctggagtacggaatgcctcctaccggcggccttggaatcggcatcgacagactgattatgcttttgacgaattctccttcaatcagggacgttttactattcccgcaaatgagacatcgttagttgactttcgtgcagcagccgcgtaacaagcggctgctgctcatttaaaacaaattaaattttttctcaaaaaagtattgcacaatcataaatacggtggtatattattattcgttgccgcaaaacggcggcgaaagaaaaaaagaacttcaaaaaaagttcttgacttaatatccgagattggatataatataaaagtcgctttaataatgatctttgaaaactaaacaagacaaaacgtacctgttaattcattaaataaatcgcacatgtaaatcctcccgtttccgggaggatttttttaacagcatgaattgtgcgctataaaatcggcgacagcaggatcgaaatggcttctttgaagcggatcgatttgcttctgtttaaatattcctcaaaggtcagctcccttgacacttgcagatctttttcaaatgataggacaaggcttctcgcaatttcctcatcatataaaaatgcattcacttcaaaattgagcttgaagctgcgcatatcaatatttgccgtgccgaccgatgaaatttcctcatctactacaatcgttttcgcatggataaaaccgttgtcgtaaataaatacggaggcgcctgcttttaaaagttcgccgatgtaagaataggttgcccagtacacaaacggatggtcgggtttgttaggaatcatgatcctgacgtcaacgccggacagacaagcgatcctgagggcatcgagcaggcttgcgtccggtataaaataaggcgtctgaataagaatggaccgctttgccgttgatatcattttaatatagccgtttttaatctgctcccattctgaatcggggccgctggtgacgatttgcatgccgatgtttccgtgggagtcgatgtcaggaaaatggtttggcatatatgtaatgtcgtgatggtgcgaggcctgattccaatccaggataaaacgcgtttgaatcgagtggaccgctgttcctttgattctgaggtgcgtgtcccgccaatagccaaaggccgggttcagaccgagatattcgtctccgacattaaatcctccgacatagccgatgacgccgtcgataatgacgagcttgcggtggttgcggtaattcatgcgcaaattgataaatttaaagcgcgacgggaaaaagacttcgacaaatcctcccgcttttttcagctctttgaaaaagcttttcctgaggcttcttgatcctaattcatcatacaaaacgcggacttcaacgccttcttttgcttttttgatgagcgcatcccggagctttttgccgatctcatcgcctttataaatataatattgaagatgaatatggtctttggcgttttcaatatcgcgaagcagcctgtcgaatttctggcgtccgtccgttaacagctcgaccgcattgtcttctgtaaaaacggcgtggttattcaaaatgtgcatataaatcaagtctttgctgtccgccgtcgctttattgcgaaattcaaactcgcggtttttcagcttggtcagctgctgttccaatattttttcaatcccgatcttctttcggtcttcccattgaaaaaggtgattcctgctcaaattgtggccgaagagcaaataaaggataaagccgagaacgggaataaagaagagcaccaagagccaggcccaggaggagcttgcatcccggcgttccctaaagatcacaacgattgccaaaagcgtatttaaaactaatataaaaccgagaaatatcgatgtgatactgatatttttaataatatccatattgaacctcacaagacggatttgtttttatacattccatttataacagttactcccctttcaagcaactatctcatgttatacggggcggcggccggaaagtttctaaagaaaaagggaggaaggcaaaaaactgtaaaacatgttggatctaagttacgatatacatataaaaagcgtgatttaattagcggaccaacgcctctttaaccaaaacgggagggattgattatggatatggaacgtttccatcaaatgccggcctttatgaaagaggaaatggataacctcaagcgcgtggcggcgccgttcttaaagaaaaggctgatttttctttttatcgcgattccgctgcttcttgcttcatttgtttatctttcctctttttgggggcaggcagcttatggaaccgattcaatgataaaaatcggctgcgctgccgcaggtgcagcattcggtatggcgctgttcagagagtcgtcataccaaaaaagaaatgttcagcaatcggtgatgaagtatatattggaacggatgcaaacaagcgaagtgctttccgatgaacggaaaagccgctacgttcgggcggtcaaagaagagccgtttactgtaatgagaagctttttggaatttttaaatgaagaagagatcagaaggcgcaggctggctgaatgattgatggaaaaaagagctgcatgacagctctttttttgtcatgatgatcaggcttcattcaattcttttcctaatatttttaagtcgtaccggattccgtccatctcggcgattccgggaaagtgtccccactcggtgaagccgtattttttgaaaagcttcatgctcggttcattgtgagcgaaaataaacgccattaaagaacggattccaagctttggagcagcttcaagcgctttttcaagcaccgcagaacccgcccctttgccgcggtggtcttcatgaaggtaaatgctgacttcggcggttttggcgtaggcgggtctcccgtaaaatgattcaaagctgatccagccgacgatatcccgtttttcattttctacaatataaagaggcctttcttcggtatggctcaaaaaccagttcagcctttcttcaggcgtgacgggttctgtatctgccgtcaccattcgcgacgcaatggtggagttgtaaatatcgactactgcgggaaggtcttcccgattggcgattcgtaatttcattctctctatcctttcttcatatgttatatcttcggcgttttttccgttatcatgcataccggtcatttttcagattttcagggcggttttacataaaaacgaaacagccggtgcaaaataaattgaaaaaagttttttgtaaatgtatatattttctgaaaagtgttcagaatgttgctgaggtgatgagttatgaaagaggaagaaaagaatcgtacttccaaaatcacaaagctgcaacaattttttcgtaaacgctgggtatttccggccatctatttgacaagtgccgtcgttgtattaaccgccgttctatggtatcaatcggcttctaacaacgatgtaaaagaccagcttgcagacgatggcaagaaatcagcctatgataaccgggatgatgcggtagaagtaggcaaaccagtcgaaaatgtcgcaatgccggttgctgattctgaaaatgtttccgtcgttaaaaagttttttgaaactgacgcaactaaagaagagaaagaagcagcacttgtaaactataataacacgtacagcatgagcaaaggtatcgacttggctgagaaagacggaaaaacatttgatgtttccgcatctctaagcggtacggtcatcaaagctgcaaaagaccctgtactgggctacgttgttgaagttgaacatgaagatggtttatcaactgtgtatcagtctctttctgaagtaagcgtcaaacaaggtgacaagattgaacaaaatcaagtcatcggaaaagcaggcaaaaacctttacaatgaagaaggcggaaaccatgtgcattttgaaatccgcaaagacggtgttgcgctaaacccgctgaacttcatggacaagccggtctccagcattgaaaaagcaatggaggaacaagcgtctgaagtgaaagaacctgctcagccttctgttgaagaaaagtcaaaaacagaagacaaagcgaaagatcaaacagatggaaaagacgacaaaaccaagcgggaagattcgtctgaagggtcagaaaatcaagacggaacccagtctgacgattcaagccagtcataaggcacgcttccctcagggcgcctatcaaatgcgataggcgccttttttgttacaatcataaaaaaacccgtatcaaatcggcggagccagccgtttattaagtaagaggcctcttttaaggagtgtgaatgcattcatgaatgaattagaacagcaagcgctgataaagtattgcctgagaatgacaggcgataaatgggatgccgaggatttagtccaggatacaatcctcaagttaatggaaatcaatcgaacagacgcgtcacatgcttatcaaaagacggttgcaaagcataaatggattgacctgctcagaaaaaggaagcgcgaaagctttctgtctgaagataatctggaagacgggcgggcagagcgcatgaaggcggccgatgacttcgagcacctgctgaaacagctttccggtattttaacaccgaagcaattaacgatttttctgctcaaagatgtgttttcctttcagctgcacgaaatcgccgagacgctcggtaagcccgaatcatccgtcaagtcgcttttatttagatcgcgtcagcgattaaaaaggctttctccggaggttctgcaaaaggagccggcggacggggatgacgaacacatcggtctgcttgttcgggcgatattgcatcacaaccccgatgatctgctcgaatttgccaaacagacatggcgtttcgacgcttcacagccgtcttgcatcagcatgatgaggtgcgctgcctaggaggaaaaatgctatgaacaccattccttacgtcattgagaaaacggctgccggtgaaagatcgtacgatattttttccagacttttaaaagaccggatcattatgatcggttctgaattcaacgatgacctcgccaatcgggtcaccgcccaattgctgtttttgtcagctgaagacaatgaaaaagacatttcgatctatatcaacagcccgggcggatcaacttccgcgggatatgcaattttggatacgatggattatgtgaagcctgatgtccgcacgatatgcgtcggaatggccgcttccatgggagcgattctcctcgccggcggagcaaaaggcaaacggtatgcactcaaaaacagcgaaatcatgatccatcagccgctcggcggcgtcaaaggacaggcgacagacatggagatttcagcgaagcggatcatcaaactgagggaaaaaatcgagcgcttctttcacgaacgaacgggccagcccattgaaaaactaaaagccgacatggaacgcgattactttatggatgcggacgaagcgaaggcatacggtgttattgatgctgttttgtaacattagaaaagctcccggcttaactccagccgggagcttcgatcttttttataaagcgtcaggaccttcctcgcctgtgcggatgttgatggtgtttttaatttcgtatatgaagatcttgccgtcaccgggttccccggttttcaggacgttttgcgccgtctcggccaccttttcgacaggcactttgctgacgacgatttcgacttttaacctttcatacacattgctttcgcgtttgaccccgcggtaaagctcagtatgccctttttgcaggccgcatccgtgtacattgtaaaacgtaatggacgttaccccgattttggccagctccgttttcagcttttcaaagtttgtaggacgggttacaatttccactttatacatttgaccgctcataccatcactcctgacaaattaatcttgatacgctttttcgccgtgcagcgtaagatcgaggcccaatgattcttcatcctctgaggcacggagtttaaaaaagatactgactatcttaataatagcgtatgtgacgattgcgacaaacaaatatgttgcagcaatcgcaatcagctgtttccaaaggagactgatgtctccgtaaaaaagcccgttggcaccgtctgcgttgacagatgtcgtcgcgaacaaacctgtcgcgattccgccccatgtcccgccgagcccgtgaagtccgaaggcatcgagcgcatcatcgtacccgaattttttcttgagcgaaaacaccccccagaaacagacgattcctccgataagcccgatccatacagatgagaatggcgtgacaaaacctgcgccaggcgtaatcgcgacgagtcccgcaatcgctcccgagacggcgccgagcatcgtcggcttcttattaatcagccattctgccaaaatccagccgatcagccccgcggccgcagccgtattcgtgttgataaaagcggtcatggcgacttcatcgatcgtcagcgcgcttccgacattgaaaccgaaccatccgaaccagatcaaagtcgccccgagcagggtcagaaggaggttgtgaggggcggtgtcgctcatatttttccgcttgccgagaacaatcgcaacgaccagaccggctaccccggaagaaatgtgaacgacgtttccgccggcaaaatcaatagctcccagctcgtcaagccagcctccgccccatacccagtgggcgacaggcgaataaacgaaaaccgcccagagcaccgagaaaagaataaaggccggaaagcgcatgcgctccgcaaagcttccggaaataatcgcagtcgtcaggacggcaaatgtcaattggaacatcatataaagcgtatgcgggatcgtctccgaataatcggcattgggttcaaaaccgacaccgtgcagtccgatccaatccaaacccccgatcaatgggtttccgggagcgaaagcgagtgaatagccgaacaaaatccatatgatagaaacgatggcaattgaagataaactgtgcataacggtgctgagcacatttttgctccttacaaggcctccgtaaaataaagcgatgcccggcgtcatcagccacacgagcaaagcgcaaaagaacataaatactgtatcccccatctgcatgtttcattcctccgtagtcatttagattgagagcagatctctgtttctttcattatagtgacaaaagggagatatcatgatgaacatgtcagatttccttacatggtttttggggagaaaagcggacagggagaggctgaaatatccgacagaagggggattaagcggttttttcaacctcaactgcaacgattcgatgtccgtccatttcttttactttaaaacggtatccttcactttcgatcgtcgttccgggcttgctctcaatattctgcgtcagcatccagccgccgattgtatcaatctcctcatctgataaatgaattccaagcaggtcgtttacgtcgctgaccagtactttcgcgtttaggatgtaatggtcatcttcgagtttctgaacagcagatacttcttcagtatcgaattcatcgcgaatgtcgccgacgatttcctcgacaatatcctcaaccgtcacaagacccgatgttccgccatactcatctacgagaatcgccatatgtgtatgctctttctgcattttgacaaacagctggtagacgggaatcgtttcaatcacatggataaccggatggatatatggctttagcgattttgtttctaaagaaaattcccctgcaagctccgccagcagcagttcttttatattgatcattccggtgatgtgatctttgtcttcctccatgacggggaagcgggtgtgcttcgtttctttgataagctgcttcgctttttttaaactgtcgtcaagagataagacggtcatttcattgcgcggcaccataatttcttttgccgtacgttcgtcgaatttaaaaatattgtttacatatttcaattcattttggttaatctccccgcttcgatagctttcagataaaagcgttcgcagttcttcctccgaataggccaattcgtgttcaccggtcggcttcaggccgaacagacttgtgatcatgcgggctgaatgattgagcagccatataaaaggaaacatgattctataaaaccagatcatcggctgtgcaaaaagcagcgtaacggtctccgctttttgaatggcgatcgtttttggcgccagctctccgacaacaacattgagataagtaactgataaaaaagcggccaaaaatgaaagaatatgtgtaatcgactcgttcaagccgatttttgagaaaaggggatgcagcaaggtctgcatcgtcggttcaccaagccagcccaagcccaatgccgtcacggtgattccaagctggcaggctgacaagtattcgtcaaggtgcgaggtcacttcttttgcggcaagagcgcccttttttttctgaatgatcaattggtcgatctttgtccgccttactttgacgatggcgaattcgaccgcgacgaaaaagcccgtaaatgcgattaatcctgctactgcaatcagcttcaataactccaatgccccgccttctcagtaaagaaggcgccacctcattttctatgaaaaactcatactggcttcataccacgtgccgcagcgcggcaaacatcatgtttatttacgcggagggcgggcaaagaaatataaaacgagtgggccggaagaggaggagacaagtatgagagtttttcagggagagggctggacatggtatcagcttggccctcacgaaaaaacaacagcacaagggctgatccagcccgatcattggccggaatgccgaaactggtttcaaggcgttccctcggccaacatcaattgccttgatatcaatgctgccgttcaaggcaaggaagcgatctacggttcatatatttacgaccaggaagcggaagttcaacaaaaccggacagcatttcatttttacttaacgaaagactattttttcacaatgaatttagatatctcgcaatttgaagaggcaaacagaaggccgatcgatcaacacttaaagcgatgcaaagacgcccctgaagtgttcctggtcctgctgggcgaactgatgagaatgtatttgaaggaacttgagcactttgaagttcaccttggaaaagtaaggtggggatttcatcatgacaacaataaaagcatcattgaactgattcataagcggcgtcacgaactcctggtcataagaagtttaattttatcgatgaaaaaggttgcaatgggccttaaagaaacttttttaaccaaatcgtttgacgaaatcgaacagcgcaggacgttttacgaaatcgacagaggcatgtcattgatcaaagagtatgcgaatgaaatcaattatttgcttcattccgaggaagtggtgacatcccacagaggcaatgaaatttttaaagcgctgacgatttttacgacgatctttacgccgatgacggctttcggcgccctgtggggaatgaacttcgaagtcatgcctgaactctctttaaagtacggctatttattttcgcttattttaatcgccgtttcgaccgcccttgtgtattggtatttgaaaaagaaaggctggaccggcgatttattgagggataaaaaacgatatatgaaaaggaagggctcttttaaataggtttaagcccgcggtatatcggaaaagcacataataaccccatcataaaggaggaattccgaatgaaactgaaggacatcatgacaaccaatgctgaatgctgcgagccttctgccccgattgcggaaattgccggtaagatgcgtgattacaatgtaggttcaattccggtctgcgagaacggaaaattgacggggatcgtttcagaccgggatattgttatcagatgtgtagctgaaaatgaaacagatgcggctgctcgggatatcatgagcacacagatggtgacagggcgcccggatatgtctgctgaagaggctggtgatctgatggcggaacaccaaattcgcaggctgccgattgttgaagatgaccgtcttgtcggaatcgttgctttgggggatctctccgtctcacatgcggatgagaaagcgggagaagctttaagcgaaatttcaaaaccggcttaaacaggttgaaggaagagcgtttttagctcttccttttttatgtttcttcactttcccactttttcagcggccaaaataagacgtgctgcctttttgcataatgaagaaggggcgcggtgtctgggagtgtgagatcgtttgcgcttgtgagcggacccggaaaaatatcagcttcagcctgctgcagctgccactctgaatggtggatatcttcataatagagctcgtttttatgcgtggtgtacaaacggtacctttcagcaagccagtattcaagcgttcctttatcagctgagaaaggctccgaaaccggttgatattctgcataaaactctgcttgtgaacgttttctcctgcttgtcagctgaaagcggtctttatgttgtgcaaagcgcatcccggcgtaaaaataaggcaagtggaacattgagcgcgcgccggcgacggccaagcgcgaagcggcgtcaagactgaaaaaataaatgcccgggacgcctttatatgctacatatgtccggacattcagctcgggaaatctgctgatgaaaggaaagggcggcaaaaaacggggacgcatatttgtcagcagaaaaggcaagataccgatccacgcttttccgttgaatgtctccaattccaaggccgccggtatttgtccgcgaatggcttcaggatcgacagcccaatgggcaaataatacatgattccatgtttgcgtcatcatccacggtccttcaggcagtggaaaagggcggtgagaagtattttttatcatagaacagctctcctttggttcgaattttgacctgttttaagcacatcccgaacctgttgtacggttttatgatttcccttttcggctaaatcaaaaacgaggatacaaaaaacggaggagtgatctgatttgttcaagcatacgaaagtgctgcagtaccctgccaaacctgaaagacccgaccctgtcttcgcaaagaaaatgcaggagatactcggcggccagtacggagaaatatctgtggcgatgcaatacctttttcaagggtggaatacgcggggaaatgaaaagtataaagatttgctgatggatacggcggcagaagaaatcggacacgtcgaaatgattgcgacgatgattgcacggctgcttgaagacgctccggtttacgagcaggaaaaagcagcagacgatcctgtcatcggcgccattatgggcggaatgaaccctcatcacgcaatcgtttcaggtctgggggccatgcctgaaaacagcaccggcgttccttggaatgcaggctatattgtagcgagcggcaaccttctggccgacctgcgcgcaaatgtcaacgctgaatcgcaaggcagactgcaagtcgcacggctgtacgaaatgacggatgacaaaggcgtacaagatatgctcggttttcttttggcaagagatacgatgcaccaaaaccagtggattgccgcgatcaaagagctggaagaaaaagaaggcgtcatcgtgcccggtaccgttccgccagaatatgaaaaagaagaagtttcgcactctttatacaatttttcggatggagaagaaagcgcacagtttgagtggctgatagggaaggcgccggacggagcggaatttcactatgagagcggccctgtcgcatatggagaaaaaccggtcttgaagcccgctccaaaacgaagccacaatacacctgactatggagaataaaaagagccgaacggctctttttttattttttaaaatgacaaaacacttcgtaaatattaaaataagtgacagatttgcagatttttttattgtcaggtaagcttactataaaaacaacagtaaggagttatatcatgagtaaagtacttatttttggccacaaaaatccggatacggatacgatttgttcagcgattgcatatgccgaattaaaaaaggagctcggcatggacgcagagcctgtccgcctcggcgaaatcaacggcgaaaccgaatacgcgcttaagaaattcaatgcagaagtaccccgccttgtgaacactgtcgcgaatgaaacagacagcgtgattttggttgaccataatgagcgccagcagagcgtcgatgacttggatcaggttcgcgtgcttgaagtcatcgaccaccaccggatcgccaactttgaaacgagcgaccctctgtattaccgcgcagagcctgtaggctgcacggcaacgatcttaaacaagctctataaagaaaacggcgttgaaattaaaaaagatattgcggggctgatgctgtcggcgatcatctcagattccctcttattcaaatccccgacatgcacggaagaagatgtcaaagctgcaaaagaattggctgcgattgccggcgttgatgctgacagctatggactagatatgctgaaagccggagctgatttgagcgcaaagacgattcctcagcttctttctctggacgcaaaagagtttacgatgggaagccataaagtagagatcgcgcaggttaacactgtcgacacaaacgacgttctctcccgcaaagaggaagttgacgcagaacttgcaaaagcggtatctgaaaaagggttggatttatttgtgtttgtcgtaactgacattttaacaaacgactcggttgtcgtcgcttcaggacaagctgcacaagcagtggaaaaagcgttcaatgtcacattggcagacaacacagcgacactgaaaggcgttgtatcgcgcaaaaaacaaattgttccgccgttaaccgaagccttaaaaggttaaggaaataaaaaaacacccgaatctcatgattcgggtgttttcttataccgttctggataccgctttccgcaatttccgcaagatcgattcatagagtgaaatgatccgttcaaaaagcggctgcacatacgtggagaatctaaacataacaagtgatacgaataaagcgaccaaaatgctgcccaatacgtcaacagggtagtggtgtccgacccaaatacgggaaaagcccgtcaataacccgaaagcaatcaggcagcttccaattttccgatgataaagccaaaaagcgatcgaaatggctaacgccccggttgtatgatcgctgggaaatgaggcgtcggcagcatggtgaatcaatacgtccacatgatgagcgacaaatggcctcggctcatagtaaaccaatgacagcaaataatttgccgccaatccgaaaatacccgtcacaccggcctgaagaacggttattttataagaacggtttccgaatatccagatcaaaagcaaaatgagcgcatacatataaatcgctttttctgtaatcaaaatcatggcgccatccaggatgtcgttgtggtttgctaattgatgaatgcgtgtaaaaagccaatagttcaaaaaatcacctttttaatagagtagtaatttttgggcagacagttaggagacgtatttcattttgcaaaagtttcattaaataacagatcgagctgtatcagcctgcatgaaaagagccgggcgttcccggcccggcgaggttgaacggcttattcagccattgatatatcccgcttctcctttgcggatgcaggtttttggctccatgtatacagaaacaggttgatgagcacgaaaacgcctgagaataaataaatgtttgaaaaaccggcttgtgccacaaccaacccgaaaacataggatccgactgcgatgccggtatcaaacagcgtaaaataagtcgctgttgcatagccgctccggtgaggcggcgaagactggatcgccaaggtctgaaggcacggtgtgatagatccgtagccgatgccgatgacagctccggatagcaaaagcatcgcactgctgtttgtaaaagcaagcaggaaaagcccggcgcaaaaaatgataatggacggataaatgacgactcccgggccgactttatcatacagttttcccgtaaacggccgcgtgatcatcattgtcaccgcgaacaccataaagaaatagctgcttgcttcaataaggccgagggatttggcataaacagagatgaaggaaatcacgcttgaataacaaaacgacacgaacaagccgaccgttgcaatccgaatcgcgcccttttcaaacatgttggaaaatgacagcctgaacacagctgaacggatgtcgtttcctttaggaatccgcaccagtgccgtacagaggatggctacagtgacgattcctgaaaataaaataaacagatcggaaaaactcattttatccagcaggttcaaggcgataaacgggccgatgacaaccgccaaattcatcgacatagcaaaatagcccagcccttccccgcggcgggccggcggaattaaatcggctgcaattgcactcgtcaccgtggtgatgatgctgaaccaaatgccttggaaaaagcgaatgccaagcagcaggtagatatcgtgaatgaagatataaagaaatgatgccaaagtaaacagcacgacgctgatgagtgccattctctttttgccaaaacgctcaataacagctcccgaaaacggccttgcaaaaatcgcggacagcatgaagccgctgatcaaaaggccgccctctgactcggagccgccgagctcctgcatcgcatagaccggaagcacggtcaatagtgcgtaaaaatagacgaatataaacaaattaatcaaaacgaccatgataaaatccctggtccaaatgggttcagcttgcttcataggctacaactcctcctggtgtccttctaacaattgacttaacagcctttggaatatttttttatcccgttcttcaaatacggaaagcatttcctcttcaaattctttcatttttaattgaatgtcatcatatttaattttggcttcttctgtcatcttgacgactttttcccgtttgtcatcgccctgtatccgttcgacccagccgtttttttcgaggcggctgacggttcttgtcacagtcggcgcttcgacgtgcaaataagtccatatgtctttctgcgtcatcggtccgtaggtgtgaagacaatataggatcgaccactgtgaaccgtaaaggccgtacgcttcgagctgttcattcgtttttttagcaaccatccgagtgctttgattgagctggtgaataatctttcgattgatatgttccattcccggactccttcaaaatagttacctaggtaaataataaactttattcattttaccggaagtcaagattagtgtaaagttaaaatttttgaagcccgaaataaaattataagagaaaccccttgtcctccttgagtttttagcataatcccatttaaatgctaatacactgatacaaacctaacaaagagagtgtttgaggtgagggatcgtgggagtatttcaaaattctacttggaaaagcataaaacgaagaagctgcgcaaatagcgaattttttcacaagacggatctcatttcacacttctcacatccattttagggaggtcgagtggtgtgcacgattacatcaaagagcgaacaatcaagatagggaagtacatcgtggagacgaaaaaaacggttcgtgtgatagcgaaggagtttggtgtttccaaaagtaccgttcacaaggatttgacagaaaggctgcctgaaattaatcctgacctggccaatgaagtaaaagaaattcttgattatcataaatcaatcagacatttgcggggcggagaagcaacaaaactaaaatacaagaaagaggaaatctttgaaagagaacccgtgcaataaggaataatggctcagaaacgagcagcgtttatcagaatttcccggtatcctccgtaaaaagccacaaaaattttatgaagaactttaataagctctcttttttttctaatatttatgataaaatatataattagggcagaatgtggacattgctgtgaaacagatttcgaggaggatatagatagatgtttgcaagggatattggtattgaccttggtacagcgaatgtgctgatccatgtcaaaggaaaaggtattgtcttaaatgaaccatcagtcgttgctcttgacaaaaacaatgggaaagtgctcgctgtcggtgaagaagcaaggagaatggtaggacgtacacctgggaatattgttgcgatacgtccattaaaagacggcgtcattgccgattttgaagtaacagaagccatgctgaagcatttcattaacaagctgaatgtaaaaggtcttttctcaaagccgcgcatgctgatttgctgcccgacaaatattacttctgtggagcagaaggccattagagaagctgccgaaaaaagcggcggaaagcatgtatatttggaggaagaacctaaggtggccgcaatcggagcgggaatggatattttccagccaagcggaaacatggtagttgatatcggcggtggaacgacagatatcgcagtcatctcaatgggcgatattgtcaccgcctcttctattaaaatggctggggacaagtttgatcttgaaatcttgaactacatcaaacgcgagtacaagctgctcataggcgaacggacagccgaagatattaagattaaagtcgcaactgttttcccagacgcacgtcacgaggaaatttccatccgcggccgcgacatggtcacaggattgccgagaaccattacggtaacgagcaaagaggtggaggaagcgctgcgcgaatctgtatctgtcattgtacaggctgccaagcaggtgctcgaaagaacgccgcctgagctgtcagccgacattatcgacagaggcgttatcattacaggaggcggcgcattgttaaacggtcttgaccagcttcttgccgaagagctgaaagtgcctgttctcgttgctgaaaatccgatggattgtgtggcagtcggtacgggtgtcatgcttgataacatggacaagcttcccaagcgcaaactgagctgatcagaagcctcattctttttgagaatgaggtttttttatgtgaaatgctttaaaggagctgaacggctgccgataaaaagagtagtatgtttgaataccattatagaacaaacgttctgtattagcaaatataaattgcaagcatttcgcaaaagaggttttttcgataggaaactctggagcatgacacttattttgaggtgaaatgatgttaaaaggactttatacagcaacttcagcaatgatcacccagcagcgccgcacagagatgctgacgaataatatcgcgaatgcaaatacgccgggatataaagaagaccaaggatcaatacgttctttcccggaaatgcttttgagccggattgagtctgattctttcaaagccggcagcgcttcgcgttcgttttcaacacagacgccaatcggttcaatcaatacaggggtttatatgcaggaactgaagcctcaattttctcaaggcgatctgcaaagcacgaatgagccgacagatattgcaatcagcgaagccgaagttccggtcaacggcgaaacaaacgataaagcggcgcttttctacgcggtccggcttgaaaatggggatgtacgctattcaagaagcagccgtttttctttaaatgaaaataatcaattgacaataaacggccgactcgtcctttcaacggaaaaccggccgatcacggtgggaagcgagaattttcaagtcgctgaggacggaacggtgactgaaaacggccaaaatctggggaggatcgatgtcagaatcgcgctcgatacgagaaatttagcaagagaaggcgatgatctgtatcgtactgaaaacggtgaggcgctgccaagcgcagtcggcaatcctgaagtcacttattctgtcaagcaggggatgaccgaacggtcgaatgtcgacgtgacgagagcctatacggaaatgaccgctgcctaccgctcgtttgaagccaaccaaaaagttcttcagtcttatgataaaagcatggaaaaggcggccaatgagattggaaggatcggataaatgaccgatcgcgatcagcgtaaatggaggatgtggaaaaacgatgcttagatccatgatcacggcttcaaacacaatgtttgaactgcaaaaacaaattgataatatcagccataatcttgcaaataccgatacaacgggatataaggcgaaaaacacgagcttttcggagctgatcaggcagcagattgaacaggtaaacgagaaaaataatgaagtagctgcaagcagaaagacgccgccaggacttcgcctcggcgtcggagccgtcatgaccgaccggctgacgcataagcagggaagccttaaggagacgggccgcgatcttgatattgcactgacttctccttatcagtacttccaggtcaatgtcggcggggaagtgcaatatacaagagacggggcattttaccttacgcctgcggcggggaacgccaaccagatgcagcttgtgacgaaagaaggacatgccgtccttgatgaaaacggaaatgccatccgcttcaaccagcgctataaacacatcaaagtcgatgaatcgggaagtgtcaccgtttcgtcagacaatcagggagaagcgccactgcgttttaacctggggatcgtccgggctgtcaaacctcaggctctaacagaagaaggaagcaaccttttttctgtcagcgatgaattgagagcaacggctcttatcaacctgaacggagccgggcggcaggacatttctctaaaacagggattccttgaatcatcaaatgtcgacgtatcgaaggaaatgaccgatctgatctcttcgcagaggtcatatcaaatgaattcccgcgccatcacgatgggcgatcaaatgatggggctgatcaattcagtacgttagcacagcaaaacaggagccggccaaacgacgtttggttcaggctctttttattttcactttcatcgttttaaaccggttgtgcctcatcttttgttgaaaaagattccgtttcataatatacttccagatgtacagaataaggcactgacatatcattctatacatatttttcgaaaaaggagatgtcaaggcaatgcttgatgctcagcaaattaaagaaatcattccccaccgctatccctttctgctggtagaccgtgtgacagaagtagaggaaggaaaacgggccgcgggttataaaaatgtgacagtaaatgaagagttttttaacggacactttccggattatccggtgatgcctggtgttttaattgttgaagcgcttgcgcaagtaggtgcggtggcgcttttgatgaaggaagaaaaccgcggaaggctcgcgttttttgcgggaattgacagctgccgcttcaaaaagcaggtgaaaccgggcgatcagctccatcttgagcttgaagtgcttcgtttccgcggttccatcggcaaaggaaaaggagtcgcaaaagtggacggagaagtcgtgtgtgaagccgaattgatgttttctcttggtgaaaagcaggaataatgtaaacacaatgggttttcgtaaaagcccatttgtttttttatcatgaaagcgaaaaggtgatcattcatgtggaaagaatttaaaagttttgcgattcggggaaatgtaatcgatcttgcaattggtgtcatcatcggaggcgcctttggaaaaatcgtaacttcgcttgtcaatgatttgatgatgccgctcctcggtcttctgcttggaggcctggatttttccgcgctgtcgttcacatttgttgatgccgaaattaaatatgggctattcattcagtcgatcgtcaatttctttattatttcgttttccatttttctatttatccgctatatctctaagctgaagaagaaggatgccgaagaagaaaaagctgctcctgatcctcaggaagaattgcttaaggaaatacgggatttgttaaaagagcagacaaaccgttcttagagctataaatgaaaaggctgtccggcgaagacagccttttttatatattttgcttaaatgcttcaagaagccgatctccggaatatccttctttcattaaatcttccaaaatcttgtcggagcctttcctcagctttgagctgaccattttgccgtccaataagacggaaacatgctcgccgagcaccgtgatgtttttgaccttcgctaacagctgtgctgggcggttgctttttttcgtgatcgttacatatgctttcacttctttgccttcctgaaggagatattcgaaaaaataccggtattctttagaaaccagcccttcaaccatccagtggttttctccgtcttccttattaatgataaggccgtcgatcagcgggaactcctcaagccgctttgaagtgtcatcctggcggacaatttttaaatcaataagcctaaaggttttcattagtatcacctcacaagcttccatagttgtataaccattatagcacattcgcttgggagaactcttgaccctggtttgtttctgcaataggagcatattcatattttaaattttgcaaaaagtattttataatgctttatttttatttatactttaggtgatattgagcaggaggtgacttatgaaccatttttacttaaaggaagtatttgtgatcgcaagcaattcagctgctgactgccgtcaatatatgcctatgatttgcttttcagccggtaacaaaaagcacgaaatcagcacatatgcaaatgaaggcatcatgtttcgctatgaaacgaaggacggaatggaaatatacgaatttcaagtaacgcttaaacagaaagagttgtcattccgtctgtatgcttgggacgggggctcatatgtccgcgtatactcagagcggtggctgtcatctcctgttttttttcagtttctgaaaaatacgtatttctcaaataaaaatgaaatgatttttatgattagtggaagaaaaaagcaaaaattatgacatgagcccggggttttttccgggttatttttcttttatgaggattttgcttaaaatctgttctcttataaactggggatacccgaacaggaagggagggacgaaatgtttaatgagatcatgctcgtcgggcgtttgacaaaagatcccgaactgcggtatacatctgacggtgtccctgttgcaaatgtgacgctggctgtcagcaggcctttcaagaacgcagcaggcgaagtagaagcggactttgtcaattgcactctatggcgcaaaactgccgtgaacacagccgaatattgcgaaaaaggctccatcatcgggctgagcggaagaatccagacccgccaatacgtcaattcagaaggtgaacgcacctttattacagaagttgtcgcccggtcagtcagatttttgggagaaagccggaaagcgcatgagccggctgatgcttaaacctaagattccttctataaactcctttctcaaaaagaatcaatcaatatccccttgtttatctccttttatggccggttttgaatgaccggtttttttattttagacaaaaaatagacaaatttaaattgacgtccaaaaattccgtatgtataatgtaagcgaatacaacaaatgaccaatgtttgcacaaatgcgcaaaggtaaagggtgatcttatggaaatgagggatgataaacgccttctgatcaaagtctgcaaaatgtactacgaagaggatatgacacagagccagattgcaaaagcaacagggatatacagaacaaccgtcggacgtatgctgaaaaaagcgcgtgaggcaggaatcgttaaaatcacgatcgatgaccatgtcgggacacactatgatttggaacgggagctcgaacagctgctcgggcttaaagaagtgtacatatgtgatgcaaaaccggaacaaacagctgaagacaagaagaaactcgtcggcaaagccggagccgaaatcttaaaacgagtcgtgaaagacggggatacggtaggcttcgcatgggggacgacgatggcgggaatgatcggggagtttcacggcgtcaaaaaacggagcgcttcattcgtgccgctggtcggcggtccgggcgccatggatacgaaatatcacgtgaacagcatcgtctacagcattgcgggtgactttggaggcacgccttacttcatagatgcggcagccgttgtcgaaaaaaaagaaacgaaggaggaaatcgtcaagtcccactatttcaaaaaaatagaaaggctgtggaacggccttactgtggcagccgtcggaatcggggcgccgcttagttcttcaaatatgatctggaccggattttacggcgatcaggatatcgagcgccttgaagaaaaacatgcagtcggagatatatgctcgcgtttctttgatcgttcgggagctttagtagaaacagagattcatgacagaaccatcgcgatagacatcaacaggttaaaggatttggaatattccataggtcttgccgaatcccatgaaaaagttccttcgattatcggggctgcaaaaggccgctatattaatgttttagtgacaactgccgaaacagccagagaaattgccgaggaggtgagaaatcaatcatgatcatttactttatcatcgcccttggagctgcatggcttctccagagcgttttaggtttttggcaaatcaggcatttcaatcgaacgttcgccgcgtacaggcgtatagggagagtcgcggtcggaaggaagaccggcttactcagagccggaacggtcgtcctgtttgtcatcgacaaacgcaacaaaattttgaaggcatcaaaaatgcaaggtgtcaccgtcttttcaagaatcagacctttaaaagggtttgaaggaaagtatttgctgaagatcggacaagcggagcttgcccggcacgaccgcctcacacgtcttgcaattgaagatgccttgagaacattcgacatcatcacgaaagggggtgatgttccgcagaagaaaacacggcttcaaaaactgatgagctttcaaatcaaaaaaagaggtgaaatatgaaaaacgtaacatggcttgcggaaaagtttatggacttattcaggcatggcggagaagtgtttgtcggtatgcttacagacatcgttcctttattgattatgctgcttgtcgccatgaatgctctgatacgcctgataggagaaaagcgcgtcgaagcgcttgcgaggaagtcgggaaaaaatccattgaccagatacatggttttgcctgtcatcggtacgttcatgctcgcaaatccaatgacgctgtcgcttggcaggttcttgcctgaaaaatacaaaccgagctattatgcggctgcatcctattcgtgccacacgcataacggacttttcccacacgtgaatccgggcgagctgtttgttttccttgggattgccgcagggattacaacgctcgggcatgaaacgacggagcttgctctccgctatcttttagtcgggattgtgacaaactttctcaggggctgggtaacggatatgacaacggcttatgtcgcgaaacagcagggcattgccttgaaagattcgattgatcttaaataagaaaggcggtttaggagatgagttcctatcgttcggttgaagtttcaaaagggcctggagggtttggcggacctctggtgatcacgcctgatgaagagagaaataaaatcgtgtacgtcaccggcggaaacaaacccgattttgcggatcatttagctgagctgacggggtgcaccctggtcgacggctttaaaacgacagtacccgaaagcgaaatggccgctgtgatcatcgactgcggagggacgctgcgctgcggactttacccgcaaaagcgaattccgacgatcaatgtgatggcgaccgggaaaagcgggccgcttgccgcccatattacagaagatatatatgtttccggagtaaaaaaagagaatattaaactgctgggagctgtggaggagcctgaacagtctaatattccagaagaaaaacaaatacaaaataaacaaaaccattatagcacagagaaaaagattagtgaacagcagtcgccgaaagggatgatggcgaaaatcgggatggccatgggatcgatcgtcagcacattttatcaagctggacgggaagcgattgaaaccgttatcaaaacaattcttccgttcatggcttttgtggctctattgatcggcatcattaaagagtcaggcatcggagacatttttgccaaatatttatcaccatttgcaggctcactgcccgggttgctactaatctcgcttgtttgttcatttccactgctttccccgttccttggaccgggggcggtgattgcacaagttgtcggttctctgatcggcgttgagattggcaaaggaaacattccgccgaatttggcgctgcctgcgttatttgcaatcaattcacaagccgctgccgactttgttccagtcggtctgggtcttgcggaagcggaagtcgaaacggttgaagtcggggtgccgtcggtgctgtattcgcgttttctcacgggggcgccaaccgtttttattgcttggctggccagctttggcatgtatgacagctgagggttttcttaaggagggagaataatggtcatgctttatgaaacaaaaataaacagaatcggagctcaagcagcggcgttttcagatgaaaagatgctcatattatttggtgaaggtgctccggatgaattgaaagattattgtttatcaattgatataaagcctgtagaaggcgacttcaatgaaggcgatgagctcatactgggcggcgagtcctacaaaattacagccgttggcggagccgttcgtcaaaacttggcgaatctcgggcatattacgctaaaatttgacggatcagtttcagccgaactgccgggaacactgtaccttgaacgaaaagaacaactgccggaggtttcagcaggagactgtattcaagttaaaagattctcataaggagcgggtgcaatatggagatgaataaaggaaaagtggcattgatatgcggcggcggccaaagtctcggagaagcgctgtcctaccggatggcagaggcgggatatgacatcgcggtcgcagacatcaacggcgagaacgccgaaaggacggcagatcatgcagccggtcaatacggggtcaaatcgctgtggattcaagcggattttacaaaggaagccgatgtgaaaaaaatgatcggcagggtcacggacgaattcaataaaatcgatgtgatggtgtacagtgcgggaatcgccaaaagcaataaaatcacggattttgaacttgaagactgggaacggaccatcgaggtcaatttgaccgggtattttctttgcgcgagggaaacgtcaaaggtcatgattgagcagggaagcgggtcaatcattcaaatcaattccaaatcgggaaaagtcggcagcaagcataatacagcttattcagcttctaaatttggaggggtcggtctcacgcaaagcctcgcgcttgatcttgccgaacacaacattcgggtgaacagcattatgccgggaaacttgttaaaatcgccgatgttccaaagcttgatcccgcaatacgcgaaaaagctcggcattccagagagcgaagtagagcgcgtgtacaccgaaaaagtgcctctaggacggggctgtacgtatgatgacatcgccaatgccatcttattttacgcctctgaccaagcatcttatatgacgggtcaatcgatcaatgtaaccggggggcaggtcatgcattaaaacaagagggggacgcgatgatgaacatgctgattgattcagcgcatataccggagattgaaagattgcttgattcatttcccgctggcggcgtcacgacaaacccggcactgatcgcaagggagaacaagccttttaaacagcagattcaagatattcggcggcttcttcccgagcatctgcctctccatgcccaagtgatcgccgaccattggcgggatatggtcgatcaggcgaaggcactctataactggctagatggaaacgtgtctgtgaaaattccggtgacgactcaagggctttacgcgatcagaaagcttgcggctgaaaatatccagaccaccgggacaacggtttataccgctgcacaggctgtactggcggcaaaagccggcgcctcctatgtcgcgccgtatgtcaatcgcattgatcaagagtatggtaatggcgctggcgttgtcaaaacgattgtcggcttattcaacacaaactgtttaaattgcaaagtgcttgcggcaagctttaaacataaccgtcaaattcttgccgtcatggaagcggggagccatgaggcgacaatcagccctgagcttataagccgtttggctgatcatccggctgtagatcgtgatatccatgcgtttcgtgagatttggcactctcaatatggaacattttcattttaaagtacgagcctgagggacgggaaaccggcctcaggctttatttttgcttatcattacttatatactcttgatttattcggcgtaattgcttataatcacttataaatgatgaactttacttgcgcaaagaaggaatgatccagtgtaccaagaggaaaggctaatttccatcatcgactatttaaaagagcataaacggatttccgttgaacaaatttgttctttattcggagtttcaagagatacggcaaggcgggatctggttaaactgcaagagcaaggcgccattatcaggacaaggggcggggcgattctgcccaccgttcatgatgaggtcaaagactattcgggcaggctgggcatggtttccgaagaaaaaagcatgatcggaaaagcagccgcttctttaatcagagaaggcgaccgcattattttggacgcttccacgacagtccaatcatgcgcagagcatttgccggatgtcaattgcacgatcatcaccaattcgattaaccttgcggacgttctttcctcaagaaaaggggctgacatccgcctgcttggaggaaagcttcaaaaagagcaccggtttttgtacggcgcctctgtcattgaaaagctgtcatgctatcatgttgataaagcgctgatcggcgtggtgggggtttctgaacatgggcttacaatcgcccatgaggaggacggaatggtgaagcggaaaatgatttcccaagcgaagcaagtcatagcgcttgccgaccattcgaaaatcgggagaacggatttttaccgatacgctgaactcagtgacattgaccttctcattacagaccggctgccgtcgaaaccgtttcagaagctgcttgatgaacacgatgtggagctgcttgtggctgaacatcacgatacttaagggggaatacagcagatgaaaatgattgcggtcgatttagacgggacgctgttaaacagtgaaagcaagatctcaaaggaaaatatcgatgcgattaaaaaagcgcgggaacacgggattgaagtagtagttgccacggggagagcatcctttgatgttcaaacgatatttgagccgacaggtattaaaacatggattatcagtgccaacggagcggtgattcatgatcctgaaggcagcctttaccattcggtgccgcttgatcggaaacgggcagaaggaattcttcgatggcttgaagaaaataactactattatgaggtgttcagcgatgaagcaatcttcacgccgcaaaacggccgcgagctgcttgacattgagctggaccgcttgaaaagcgcaaatcctgaggcagacctatcaaggctggaactcgcggctgaacagcagctcagccaaaacggatacgcgtacatcagctcctataccgatctgtttttagccggaaaggatgttaatgtatataacatattagctttttcttttcataaggaaaagctggaaacgggctggaggcaatttgaagatgcacaagatattacgcttgtcacttcagccgagcacaactttgaaattgagcatcttcaggcgtcaaaagggctggcattggagaagctttcacacaagctcggcatttcccttcaggaaacagctgccgttggagacagcctcaatgatttttcgatgctgaagatcgcggggaaaagctttgccatgggcaatgcgcgcggagacattaaagagatggctgatgaggtgacgctcactaatgatgaaaatggcgttgctcacatcctgcatcagctgattgaacagcaagtcaaaccggtttaattcgtacatcctttcaaatcggcgtgatgccggtacacggcagcgtaacgattgaaggagtgcggttaagcagcggatgttattggtccgcgggccgccgacattgtcggcggccttttttaatatggtttgacctcgatgattatgacttttgattctttgttggcgatggttgtttttgttactattcctatttaactattgattgaatttgaaataataggatcacccgcttaaaaggagagtgataagaatgaaacagccgttccaactacccgaaaaaatggcccgattccgcgggcaattcgaacaatcagcgcgggattttttaattgggactgtcattaaggggcataaacacaaaaaacagctgtctatcgcagacagctgttttatttaacctgtaatagccgaagcgttcagggtaaataactcctcaagttcatgctcagaaagctcggtgatccaattttcgctttggatgatttgatcgttcagcgattgcttcgattcgagcatttggtcgattttttcttcaattgtgccggtggtgatcagtttatgaacgtggacgaaccgtttctgtccaattctgtaggcgcggtctgtcgcttgattttcaaccgcgggattccaccatctgtcataatggatgacgtgattggcggccgtcaaattgaggcctgtgcccccggcttttaatgataagatcaaaatcggaaattccttgttttgaaactgctccaccattttgtcccgttcaagcttggataagctgccgttcagaaacttgaccggttcgccgaatgacttctcgagcaggcgcttcatcatatctcccatcccgagatattgggtgaaaatcaagcagctttcatcgctttcgcgaatcgtcttcgtcagctccagcagtttttcgagcttgactgaccttccgttaaggagctcgctcccggtctcttttaagtaaagggcagggtggccgcagatttgtttgagcttgccgagcatgcttaagattagagctttgcgctgcattccggcgaggcttgacatatgttcaaacgtatctttgacaagctgttcatatagtgaagcctgttctgcggagagcggaacgaactctttttcctcctgtttctcaggcagattgagcgcgacttctttgtcctgctttgtccgtcttaataaaaacggtttgatcagctgctgaagctgttcgatccgtttttcgtcgcggtctttttcgattggcaggacaaaacgcttatggaagctgccaaggcttccgagatagcctttgttcatgaaatcgtagattgaccacagctccgtcaggcggttttccatcggagtcccgctgagcgcgatatgatgcagtcctttcagctttctgattgaacgggattgtttcgtgtgcgcatttttaatgttttgggcctcgtcaaggcagatgcagttccaggcgacgctgctgagatcgtcaaagtcggattgggcgaggccgtatgacgtcaagacgatatccgcatctttgtaagatgtctgaaacgcttcacctttagggcgttttggcccgtagtggagcgctgccgtcaggccgggcgcgaaggtctcgagttcgcgctgccagttcccgaggacggaagtcggcgcaatgataagagacggcgtttgttgtccctgttcttttaaataggcgaaataggcgatcatctgaatggtctttccgagccccatatcatctgccaggcaggcgccgaagccgcagtttctgagaaagatcagccagttcaaaccgtcttcctgataagctctgagcgtcccgtgaaaatatttgctgaccgggtatgacgggagatcatcgcgctggctcagctttctgatcatgtttttcagctgataggacagttcaaaccgtacatcgctgaatgcggaagcatcgaacagatcatcatcctcgcgggtttcgctccgctctgtcagctcgcgcgccaggatgtcagacatatgaagcccctctgtttctgcccgctccatcagctttttcatttgtttgataaaattcgggtcgattttgatccactgcccgcgtatattgacaagccgtcttttattggcgacaagctgctcgaattcttcctctgtgagttcaattccattggtggcaaaacgccagttgaagtccatcaatgcattcattccgacaaaagactcgccgcggggagccgatgacacttttgctttcagcagcatattgctgtctctcacgatttgccaccatgacggcagcagaatttcaatccccatgctgacaagtgtttcgctagcttcggacaggaagatccatgcttcctcttccgttaaaagcgacgtccccgattcgatcgtcagccagggcacgatttggcggaacctgtcttgttctcggtcgattttatcagcgtatgcctgccacgattttttcagcctgttcaagccttcaaagaactgaatggctccgctttttttgtcgcgcaaaaacagttcgattttccaatcgtctccgtcaaagtcaggttcatttaagcggagtccgacggtaaacggcacagggttttcatgccagccaatcgtttcaagaaaatcgtcttcatcaagaaaatgtccctgaaatgtggtgactgcgggggaatgtgcgacaatcgattcccattttgcttttaattcgtcattgtagttgatgtagtcttcgacagcgtgtgaaaaccattcggctgtatagccttccaaaatcccttctttatctttccagcgcagcatttcctgcttccatgcttcatagtcgggaagaaagtcttcatctgcgataaactcataaatggtggaagccgttttcatcaaaggttcagtttcctcagtaaggatgatgtcgctgaatgaattaaatgagtttttgccgagaaattcgaccgccatccacggggacagcagaaccgcaggggtatctaaaccggcttcctcgagaaatgttccgtaaaaagacgattcgtgccactgaaacaaatgcctttccatttcatttcgcgtaagaaactgatgatccccgtcatgacaagataaaataaatgtatagtcttctgactgttcgacatgtattacgatttccttaagactcgccatcgatcaactttcctttcttaagctcctcctggaaggctctcagccgtttatagcgggctgaaaactgctccataaaccggttccagacatcctgttttttcgcttttttataaagggtgcgcagcttttttaattgtttgacggcttctttgtagcttgagcggtttttttgttcaaccagcccggaaatttctctgtgataggaagggatcaatgcttcaggagccgctgccgcaatgtctttcaaggcgttctgccctatctcagagattgaaaaaccgacaaggctgtggatctccatccactccgtaaagcggtttttgttatataaaaaatggctgtattcagtaaatgtataaggaaggcactctttgcaataccgttcaaatacatgctcttcttttgcgtttttgctgtaatcgcttagaaacaggaagaattcgcttagtacatcgcgtatttcccggtacggtttatccagtctgcagaagccggccgccagctgctcaaggtgttcataccattttttcaggcgcttccagtcttttttggcggtcatgacactgagccattgaaacgtatacggaagaatctccggtgaaaacgatccggcttgatcaagaatcacatcgtcgtttttcagcagaaattcaagatgcagcctgccgaattgtatttcaggcgaaggctccagattgttcagcacatcgagctcccgcttcagccagtttggccgggacagaagcgcactccagatctccccgaaaatccgcagcctttcatactggaaaatatctttcttgagcagcagttcccgaatcacgccgggggttttttctaaaaacgggtcaagggagaacgatagcgcatatgttttcagttcatcgatcgagctgtagatcgtatccatcagctgttcgatataaggattcagcgagtaaaaatctttttcaggatcgatgcgccctttctcgacgagtgaatgcatagcaagccatgtcgcaagagccgcgtggatttgatacatttttttcagctccggctccgcaggcgtccgcttttttaaagctgaaaaatacccgtagtaaaggtattgcatcgtttgctggtttttaggcgtatgctcctcccagcgtctgaactccgtattgaaaaaggaggtccattgatcgagcgtgtggctgcggggcttcattccgcgctgaagctgtccgagaatctcccggttttcgcggcgtttttgcgcttccttccaaaactccgtaaatgttcccaatcgatcatattgtgcatatagatataagtaaacggcaagcacatgacggcacatgttttgagcagggcaggaacagctgctttttttaacgtcggcgaggtcgatgaagacctttaccgggacaacgtcctggacgtaagcgctgaccgtatgcccgctcatcggcttgacccgatagacggaatcctgtctgtataaaataagggcttttttcatgagctgaatgttttcttctgtgcacggcagtacatgcttaaactgttcagctgcatccatcacaaccgtttttgagatcatgtcttgaagcatgtctatcgctcctaaccgaatgacttttaaaaagtttccaatctctctattatagcttaatcaatccgtccaaaaaagattttctcaggaaaaggacataaaaacggatggctgtcgaataatgtaatagactatggcaaatcgattctttacatcatataatttgaaatataatcagaaatgttttaatttatggaagctgaaaggaaaaggatatggatgacaaggaattgaatcaggaagaatttttgagaattcttatgcatgcgtatgacgttggtgaaaaatcgaaagacataacgacgaaagaacttcttgaagatctcattcttcatatcaaaaatggatatacgacgtaaaaggtgtgcaaactgcggtttgcacactttttcgttcagcaagaagtgcgcagatcctgcaaaagtcgatatttaataccatataaagacgcggtttccccggtatctcccgttatttgtcaggattcatttctttcggaaacgaaataaccatgtataatcaaaggtaggtgtttaatttgctgaaaatttaaataaatacgcgaatcgtagaagggggcttttatgagagatcatatcggctttaaagatgtgttcatcgttttgaaaaaaagattcgttctgatcgcactgatcaccattgcggctgctttgtccagcgctgccgtcaacttttattggctcaaacccgtctatcaggcatccgcccaaatcctcatcaacggccgtcaaacgtcgaacttcaccgacatccagaccaaccttgaacttatcaacacatacaacgtcattatgaaaagcccgatcattttaaataaggttaaagacgaacttaacctttcggaaacggctgaagacctgaagcaaaaaatcacggttatcagcgaaaatgaatcgcagattgtcagtatctccgcgactgacaaggattattccaaggcggcggatatcgcgaatacagtcgccgccgtatttcaaagagacattggcgatattatgggtgaaaatgccgaaatcagccttgttgcgaaagccaatcccgatcattcacctgttcccgtcagcccgaacaagaagttcaacatcgctctttttacagggttcggccttctgtttggcgctgggctagcatttttgctcgagcttttgaaaaataccgttcgaaatgaagaagacatcgaaaaagatctgaatgttcacgtgttgggaaatattctgtatgtaaaaccgaaaaaaggacaggccaggaagctggaaagctttgtcggcaaagaccatacattctgaaacgggaaaacacggggaggtcgcatatgatcgatattcattgccacattcttgcgggcgttgatgatggagcagcatgtatgaatgacagtttagaaatggctaaacaagccgccctccaggggattcatacgattatcgccacaccgcaccaccgaaacggtgtatacgaacatccaaaagaagccatccttgcagctgttaagacgagaatgcaaaaggaaaacatcccggttctcattacccccgggcaggaaatccgcctgtacggcgaattgaagcgcgatcttgagcgcggcagactgctcagcctcgccggcacaaagtatttgctgattgaacttccttaccaccatgtcccgcgttatgccgaaaaggtgctgttcgatctccaattaaatggttacattccgatcatcgcacaccccgagcggaaccttgaattgatggagaatcccgatctgctgtaccgcctcgtcaaaaacggcgcctgcgcccagctgacatgttcaagtcttgcaggccgtttcggcagaagcgtcaaacggctcgcccgccgctttcttgaagcgaacctcatccactttatcgcatcagacgcccacaacctcacgacccgatctttcttttttgatacagtagaaaacgattacggccgcgatttcttgaacgtgtttacagaaaacgcgggcctgctcctggaaaaccgggagattcataaagaaacaccgcgtcccgtcaaaaagaaaaagctgttgggcctgctgtgaaagttgttcacaaaggcccaacagccaaaatgtcagcaccggttatgcggcgctgatttttaatgtcatttgataaaaagcggccggacgtccctctctacagcagcggaatgacaagcccgccgtaagcgaaggccgccacgatcaggaaagccggatggacgcggaacttcgtcaaggcgactaaagagatcagcgcgatgacaagtgattgaaccatgccgatcgaatggatcgcgtcgccgctgatttcccatgttaaaagaagcatcatcacggctataaccggctgaaccgacaaggtcattcctttgacgacctgcgactggcggtagcggccgatcagcttgagcagcaaaacgagcgcgatggccgagggaagcacagttgcggcaagagcaatgaaaacaccgggccatccgagcacgctgtagccgacataagctgcaatttttgtggcgatcgggcctggcagcgcatttgcaagcgcaagcatgtttgaaaattcctcttttgacagccagtgaaaatgctgaacaacttcttcaaaattaagcggaattgaagctggcccgcctccgtagcccaataagtttgcaataaagaaggcccaaaacagataaaagatgatcatgaagcggacactcctttatccttttctcgggccgcttttctttttaatttaaaatggaacgcgccatacgttaaaaacaggatgacaatgatgccggggtggatggaaaacacttgaagacccaaaaacgcaagaataaagaaaagcacgccggtcagcaagccgaagcctttcaatgctttttgcccaaattcgtaagccatgatgccgagcatgacggcgatgacaggggtgacagcgccgatcatgccgcttacgatttttgagtggctgagcacattaacggctgcgaacaaggcggccatcgcggcgcatgtcggcatgatatgggctgctgtagcaacgacagcaccaggaacgccttttactttatgacctaaatatgccgacattttcgtagcgatcggcccgggcagcgcattggcaatcgccaaaatttccccgaattcatcatcatcgatccatttgaacttagaaacggcttcatgacggatcagcgggataacagatgggccgccgccaaagcccaatattcccgttcttgtcattgcgatgatcagttcccggtaagggtgcttcattttgcgtttcctcctattcagttaaagcttcattcccattcggctcttataacgtttaatcagcatctggcagtcgacgctcaccacgcctttcagggggtacaggcgcttcgtcaaaaattcctccatctcctgatcatttgcgaaaatgccgtgcatatgcagcttgctcggccctgtcatatgatagaggcttgtcacggcgggctccttttccaaagcaacggcaacagcctctaaatattggggttcgacttcaacgttgaaaaacaccgatacgtgaatcccgaccttgactggattgatgacggctgtgaatttttcaatgatgccttcttcaatcaagttgttgatccgcgtctgtacggcaactcttgagagtcccacacgctttcctaaatccgtataagagattcttccttcctcatgcaagatcgaaaggatttttttatccgtttcatcgagaattaaatttggcatatggtagtcgaggctcacaaatatcccttcctttctgtttggtcattatcattcgaaattgcttgtcaatcacactataaatgaacattttgtaaattgtatcataataagggtttcgatatgaatcattttaacgttgttttaatacttattgaaaaaagggcgttagtttttctttcctgaaagtagcgcctcttttaacgggccactatacttcaaaggacaaatgaatgcttgaaaggaaggaatgagctatggagaagctgaagatcggttcgaaacaaatggttgtcagtcctcattatctcgcttcgcttgcaggcagcatcatcatggagaagggggggaacgcgtttgacgccgctgttgcagtaagcgcgtgcctagctgttgtctatccgcatatgacaggactcggaggggatgccttttggctgatgtatcacaatggaagcggggagatcaaagggtacaatggcagcgggcggtcggggcggaaagcggaccgggatcagtataaaggagagcgcgccattccggtcaggggcccaaggagtgcgattaccgtgccggggatggtggacagctgggccgaaatactggctgcgtacggccgtctatcgcttcgagaggtgctgaagccggcgattatgtatgcagaaaaggggttcccggtctcgcctgatcaatgtcaaaacacggtgaaaaacgctgaatggctttcctgtatgccgatcactgcagatatttatcttccgggaggaaaaccgccctctccaggtgagcgttttgtgcagaaagagctcgcgcgcactttgacgttgatcgctgagaaaggaagagacaccttttataaaggggaaattgcccaagctttagcagcctatctccaaaacaacgggggcatcttgaaccttgaagatttcgggctgcatcgaggggaatgggtgtctccgctttcctccacatacagaggatatgccatctatcaaatgcctccgaattcacaaggatttaccggtcttatgacattgaacattttggaaaactacgactttggcatgatcgagcacggttctttcgagtattatcatctgcttatcgaagcattgaaattaagtttttccgactgcaacaaagtattgactgacccggaattctcacagattccgcttggacgcctgctggacaaagagtatgcccgggagctggccgcaaaaatcggactgccggcgcttcaggcggagagccggccgctcggcagcgatacagcttatgcagcagcagtagatgaagacgggaatgctgtttcgtttattcaaagtttgtatttcgaattcggctcaggtgtgacagctggagataccggcgttattttgcagaacagaggggcgtttttctcgcttgatcccgaccatgtcaatacgctggagccgggaaaaagaacttttcatacgctgatgcccgccatggcgtttagaggcggcaagccgaaattcctttacggaacgcaagggggagaaggacagccgcagacgcagacggctcttattacgagaatggtagattacgggatggatccgcaaacagctgttcatgaaccgagatgggtatggggcagaacatggggagagcgggtggaaggtgtaagaatagaaagcagagtggcgcctgaagtgattgcaaaactgcgaaagcatgggcatcatgtaaccgttgtcggtgaatttgacggtgtgatgggtcatgccggaatcattgagattgacgatcaaggcttcctgagaggggggagcgatccgagaagcgatggggcagcaatcggcatttaactgcgttttcaaaacttgcaaacgtctatatgaggaaaaaaccccgtgaacaaggaggagttgttttctttttttcgaataagcaattcagcgatataataagggaactttgactcgactatatgtaaaaactgttggatgatgacataatcatcgctggcactttgaagaagaaggtcataccaccattctgtttcatacctggcaatcatgcttaaattgtaagcaaccaagtaatgcaccaatatttccgggagctttaaaaagcgatcccgttcagccggaaaataatatgcgccatgttccaaatcataaagcaaggtagtcgaagtgctgggacggcattctttttgagcggcggaaaaaatgatcccctctttttcttcacggcagaaagaccagtttaaatggtattcgacatgttcgatgaaacgctttgacgacatattgtaagcatcgggcgtctcgcttggcagccaaatgagccggtcttcgacggctgcttttactattggattcggttttctttgaaatgccagtactttattgatctccggaattctcgccaaaagctgcttcatattgaatcgttcatcttccaatccggataattggaaaagggacctgatgacgtgcatacataggccgttcctttggatttttacttcatcttcataaaagcggtaattttgtttttttcgttttctagtggtcacgccatgggcgagcactgaagtatggcttggataggaaggatctgtcgttaacaggcaggctttcaatagctgtgccatgccgtaaaataataaaatcggtttgatttccaacgtagcgattttggcttgcttgtaaaaggcttccgcatgtttaagaaaaaaaataaaccgctctccgtttttataggaattttttttggcatcttccattccttgatttttatataccatttcaagaaaatgctgggctgtttcgaccgaataaaatagctttaaatccttccatcctttatcttgcatggactccacttcccttatggttattttctaaaaattacaactgtttctcgctttcttgacagtgggtattcaagttgataatctacatataatattttgccgaaaagagggggatttactaatgtgggaaagcaaattttcaaaagaaggcttaacatttgatgatgtattgctcgttccggctaaatcggaggtacttccgcgcgacgtcgatttatcggtagagcttacaccgtctctcaagctgaatgttccaattattagtgcaggcatggatacagttacagaagctcaaatggccatcgcgatggcaaggcagggcggactgggtattatccacaaaaacatgtcaattgaacagcaggctgagcaggttgacaaagtcaaacgttcagagcgcggcgtcattacaaatccgtttttcttgacaccagagcaccaagtttttgatgcagagcatttgatgggcaaatacagaatttccggtgttccgattgttgacaatgaagaggatcagaagctggttggaatcattacaaaccgtgatctgcgatttatttctgattactccatgaaaatcagcgatgttatgacaaaagaagagcttgttacggctcctgttggtacaaccctggatgaagcagaaaaaattcttcaaaaatacaagatcgaaaaactccctcttttagatgatcaaggtgttttaaaagggctaattacgattaaagacattgaaaaagtaatcgaattcccgaattcagcgaaagatgttcacggccgcctattggttggagcagcggttggtgtaacaggcgacacaatgacacgcgtcagaaagcttgtggaagccaatgtcgatgtgatcgtcgttgataccgcgcacggccattcacaaggagtattggataccgttaagaaaatccgcgacacttatcctgaattaaatatcattgccggtaacgtcgcaactgccgaaggaacaaaagcgcttatcgaagctggagcaaatgtagttaaagtcggtatcggaccggggtcaatttgtacaacccgcgtagtagccggtgtcggtgttccgcaagtgacagcgatttacgattgtgcgactgaagcaagaaaacacggcgctgcgattattgcagacggcggcatcaagtattccggagatattgtcaaagccttggctgccggcggtcatgccgtcatgctaggaagccttcttgccggaacatctgaaagcccgggcgagactgaaatctatcaaggcagacgctttaaagtttatcgcggcatgggttctgtagctgcgatggaaaaaggaagcaaagaccgctacttccaagaggaaaacaaaaaattcgttcctgaaggcattgaaggccgtacgccttataaaggccctgttgctgataccgtttatcagcttgtcggcggtttgaaatccggcatgggctactgcggaacgaaagatttgcacgcattgagggaagatgcgcagttcatccgcatgacaggagcaggcctgcgggaaagccatcctcacgatgtgcaaattaccaaagaatcgcctaactataccatttcctaatcaaatatgacaaaaattaaaccgtagacagagtgatactctgtctatttttttttgcttcattatgataaaatttataatgttgtgtttgaaaaatgtcttaaaaggctttgatatagattattagtctgatgaaaagcggaggtatcacgatttgaaaagcaagagattaaagcagctgatcatgttaatcgttgcttttgccgtgactgtaggtgcattttctcctatgtcaactgcaaaagctgcaaatgatccaatcaatgtagacgcgaaagcagcaatcctggtggaagcttcatcggggaaaattttgtacagtaaaaatgccgaccagcgtcttcctgttgccagcatggcaaaaatgatgacggagtatcttctgttggaagcgattcacgaaggcaaagtgaaatgggatcagaagtacacgcctgacgattatgtatacgagatttcccaagatcgttcactatccaatgttcctcttcgtaaagacggatcatacactgtaaaagagctttatcaggcgactgcaatttactctgcaaacgcggcggctattgcactttctgaaattgttgccggttctgaatcgaagtttgtagagttaatgaacaaaaaagccaaagagcttggaatgaaagatttcaaatttgtgaatgccacaggtttggaaaacaaggatcttcacggcaaacatccgagcggaacaaatgccaatgaagaaaatgaagtgtctgcgagagacatggcgctccttgccgatcatttagtgagcgattatccagagatcctcgatacggcgagcattgccaaaacgaagttcagaaaaggcacagacgatgaaatggatatgccgaactggaactttatgctgaaaggccttgttcagcaatatgaaggtgtggacgggctgaaaaccgggtcaaccgactcagccggatcatgctttacggctactgctgaaagaaatggcatgagagtgatttccgtcgttctgaatgcgaaaggcgaccttcatacggcgcgatttaaagaaacgaaaaaaatgctcgattatgcatttgaaaacttcactatgaaagagttttacgcaaaaggcgcacaagtgaaaggcaacgaaacagtcacagtcgacaaagggaaagaaactgaagtcggcatcgtcacagaaaaagccttttcaatgcctgtgaagaacggtgaagaaaagaattacaaagcgaaagtgacgctgaacaaagacgagctgaccgcacctgttaaaaaaggtgagaaagtcggtaccttgacggcctcctataagggagaagaaaaggactacggatttctcggcagcgatgtatcaggtgtaaacctggtgacaaaagaagatgatgagaaagcaaactggtttattttaacgatgagaagcatcggcggcttttttgccggtatatggaacagcattgttgaaatggtaaccggctggttttaaaaaataaagagctctatttgatagggctctttattgtcatattcagatagaattaccatttacaatcctaacgatttgttattaaaatagaaataatcttcgtgtttttcatatgattttgtggaattataggatacaataggattaaatctgacaattcaatctttgattagggggatccttgaaatggctcaaacaggtactgatcgcgtaaaacgcggtatggcagaaatgcagaagggcggcgtcattatggacgttgtcaatgctgaacaagcaaaaatcgcagaagaagcaggagccgtcgcagtcatggcgctggagcgcgttccggctgatatccgtgcggcaggcggagttgcccgcatggcagatccgactattgtcgaagaagtgatgaacgctgtttcaatcccggttatggcaaaagcacgcatcgggcatatcgttgaagcgcgtgttcttgaagcgcttggcgttgactatattgatgaaagtgaagttttgactcctgcagatgaagaatttcatttaaataaaaacgaatttaccgttccatttgtatgcggatgccgcgacctaggagaagcgacgcgccggatcgctgaaggagcttcaatgcttcgtacaaaaggcgaacctggtacgggcaatattgtggaagctgtccgccatatgagaaaggtgaatgctcaagtgcgcaaagtagtcggcatgagcgatgacgaactgatgacagaagcgaaaaacctcggcgctccttatgagctgctgaaggaaattaaagccgaaggacgccttccggttgtcaactttgctgccggcggtgtagcaacacctgctgatgctgctctaatgatgcagcttggcgctgacggcgtattcgtagggtccggtattttcaaatccgacaaccctgcaaaattcgcgaaagcaatcgtagaagcgacgacgcatttcacggattacaagctgattgccgagctttcaaaagagcttggaactgcgatgaaagggattgaaatctcaaatctgctgccagaacagcgtatgcaagagcgcggctggtaaacacgaaggagacggattgacatgctgacaattggtgtacttggacttcagggagcagtaagagaacacattcgctcaattgaagcatgcggagcggccggaaaagtcatcaagtggccggaagagttaaaggaaatcgacggtttgattttgccaggaggcgaaagcacgacgatgaggcgcctcatcgatacgtatcagtttatgaagcctcttcaggaatttgccgcatccggaaagccggtatttggaacttgtgctgggctgattatcctggcgaagaacattgccggaactaacgatgcccatctcggggttctggatgtaacggtagagcggaattcctttggaagacaggtggacagctttgaagcagacttaaccgttaaaggacttgagggaccgtttacaggcgtatttatccgcgctccgcacattttggaagcgggcgcagatgtagaagtgctttcggaacacaacggaagaatcgtcgctgccaaacaaggaaatcttctcggctgttctttccaccctgagctgacggatgatcacagaatgacgaaattatttgtcgagatggtggaaaagcataaacgggaagccgtcgtataaaacggttgaaagctgttaaaacttgtagtacatttataagacaatatagatcgaaaagcgttgataggaagcagtaggaagcctctctttccaagagagccgatggttggtgcgaatcggcgaaagatgctgtccgaatccatccttgagcgaaatgctgaacagtcaaagtaggcatttacgggagaaccgttatcaaaataagcggaaagcaggaggtagacgcctgttttcaatcagggtggcaacgcgagagctctcgtcccttttatttaggggacaagggctctttttttcggtcaaatcagtataaaaggagcgaggcagatgcttgatgtcaaactgctgcgggcaaattttgaagaaatcaaacaaaagcttgcccacaggggagaagatttatcagattttgatcaatttgaggaattggatacaaagagaagagaattgatcgtcaaagtggaagagctgaaagggaagcgcaatgaggtatctcagcaggttgccgctttaaagcgcgagaaaaaagatgctgaccacctcattaaagaaatgcgcgaagtcggtgaagacattaaaaaacttgatgaagagctgagaacggtcgagtcttcgcttgataaaatcatgctgtctatcccgaacatcccccacgagtctgttccggtcggtgagactgaagacgacaacgtggaagttcgcaaatggggcgaactccctgagttttcgtttgagccgaagcctcattgggatattgccgatcaattggatattctcgattttgaacgggccggcaaggtaacgggaagccgtttcgttttctataaagggctcggcgccagacttgaacgcgcattgtataactttatgcttgatctccacgtagacgagtacggctatacggaagtcatcccgccgtacatggtgaaccgcgcaagcatgacaggcaccggacagctgccgaagtttgaggaagatgcttttaagatcagggaagaagattatttcttaattccgacggcggaagtgccgattacgaacctgcatcgcgatgaaattttgtcagctgacgagctgccgatcaattatgcggcgttcagtgcgtgcttccgttcagaagcaggctctgccggacgtgatacgcgcggtttgattcgccagcaccaatttaacaaggttgaactggtgaaatttgtgaagcctgaggattcatatgaagagcttgaaaaactgacaaatcaagcggagaaggttcttcagctgcttgagcttccttatcgggtgatgagcatgtgtacgggcgatctggggtttaccgctgcgaaaaaatacgatattgaagtatggattccaagccaaaacacatatcgcgaaatttcatcatgcagcaactttgaagctttccaggccagacgggcgaatatcagattcagaagggaagcaaaaggcaagccagagcatgtccatacgctaaacggatccggcttggcagtcggcagaacggttgccgcattattggaaaattatcagcaggaggacggaagcgtcatcatccctaaagcgcttcgtccatacatggggaacagagacgttattcaaccataaaaaagtgcgcgccaataggcgcgctttttttattcgagtgaccagacggcggctacatttcgcgcacagcgcgtaagatttgaacttccatcggcaagagcgttctccaaggagctgatgccgggcacgatcgaaaagagagcggaaatgccgatatcataaacaagctcgcagccttcaccgagcgatccggcaaatgcaataaccggaatattttcgctgcaggcgcgttttgcgacgccggccggcgtttttccgctgaccgtttggccgtctatttttccctcgcctgtaattacaagatcggcccctttaatgcgttcagaaaaagacaaagtatctaaaacaatgtcaacaccgctttttaattccgcttttaaaaaggcgcacaggccagctcccaatcctccggccgctccggctcccgggagtgaatcgatttcgcatcccagctctgctttgacagctgcagcataatgttttaagttttgatccaagtgggccgtcatttcactgttcgctcctttttgcggcccaaatacagcggaggcaccgcgaggacctgtaagaggattatcaacatcacaggcggcttcgaattggatatgctttaattttggatcaaggccgctcacatcgattttggcaatctcagctagtgcaccgcccccattttcaatctcttctccagcgcggtttagaaacttcacgccaagtgctgaagccattcccgcgccgccgtcatttgtcgcgcttccgccgagtccgatgatgatctgggacactcctttttccgcagcatccagaatcagctctccggttcctctcgttgttgttaacaggggattccgctgttcaggtggaacgaggtgaaggcctgacgcttcagccatttcgatgacagccgtttttccgtcaccaagcaggccgtaagctgcctttacgggcttcccgagagggccagtgaccgtttgatatacaatatctcctccggtagcgtcaaccagagcctgaacggttccttcgcctccgtcggcaaccggaatattgacgtattcggcgtcaggcagaatctctttaaagcctttttcaatgcttctagccgcctcaagcgatgtcatgctttctttaaatgaatcaggtgcgattacgattttcatggtacctgctcctttttaaataaagaattgaaaaattccaaaaatcaaagtcgagataatcgttaggattaagccgatgaccgactcatatggaatcagctttaaacgttctttcatggccatgaatacgctgcctcccgtcgtatgaaaaaagcttccgtgaggcagatggtcgagcaccgttgctccggcgtgaatcatcgccgcacctgcgaggccggcgacgccaagatcaagcaatgtcgggccgaatacgctgctggcgacagcggtgccggcggttgtcgaggcggttgccattgacatcagcatgcccgagattggagccaagagaaacgacggtagacccaagccgacaagggtgtcggtgattaaagaattaagtttggagttggcgatgatgcctgcaagggttccagtcccgagcagcatcacggcaacgcctgacatctttgacagtcctgaagcggcaaaatccctcagtttgcccgcttgccccgatgcgatcgcagtgacgaggcctccagccggcagagcgataatcggatcaatcgtaattcctgccgcaggccttaaggcgagcaacaggatagagaccacagggccgctgaccgccgcccaaaatgccggcagttgttgtgccgtttgggtctcaatctcatttgcagctacttttgttcctttatttgaaaggcgttttgccagcaagtaagtggcgcccaatccgaaaatagcggggatgatcccggcggccatcacggatgtcaaagggacgtgaaaggcatctgaagcggcaatggcattagggtttggcgacatgatattgcccgcttttcccccgccgatcatcgccaacagaatggccgctttgctgataaaggtccgcctcgcgatcgccagagcgatcggagcgactgtgatgacggcgacatcaacgaatacgccgaccgttgttaagatggctgttgccaatgttaaggcaagaagcgcccttttttctccgatctgattgacaatggtttccgcaatcaccgctgcggagccggattgaatcagaacgccggcgagcacgcctgccgccaagatgcggagcaccgcgggaatcatgtttttagcacctgctatcatgagatccgtcgtctctattaaatctgcgccgccgattaagcctccggccaatgcgccgatcatcatgccgtaagccggcgggacttttttcagaatgagaaagattgatatgactaatgcgcataaggcgcctattgcattgatttgaatatccatgtgcataccctcccttacgtccaattgtaaacgctttctgtatgagggagaattggtcaggtatacggatttcgtccttttatcctatatttaaattgttcatttgcacaaaagggtgaaaaaagagtaatggctgtatacagtttgaataggtcgtcaaaccgttttggattacaccccgttgccaattcaatctttctgagccggtagtttaaggtgttgcgatgaataaagagtcttgatgaagtttccccgatttcgccgttttcttctatgtagcagaggagggtatgagttaattcgcctttttgatctgcttgggaaaggcgatcccagatgttttgaaagtgaatctcctgatccggatgctctatttttgataataaaacaggaatcgcaaactctcgataatcgtataaactacaattgttttcagcaatcttgagcgtttgttttgcactttgataggaaaatggcagctgctgaagctggtcagcctgctcgccaagcgcgcctctgactgttttccattggctgagccagccgttccaagctgaaaagagatcagacctgcttttagtgggggcgcctgccagaataactgcgacctcttttaaagaaatattggcgtacaaatctttcgcggttaaatgtttttcaagttttttaataaacgccggcttcatatcagccgatgggagctcaaacacaagacaagtacgctggccgtcaagcggtatgtttaatcgctctgcacgttcaaagaagtcaagggatgctagatcagtcccctgaatcatttggatgaccgtttcttcgcggagcctttgatcccatgtcagctgttttgttaaaaatgcctgttcgactgttagctccgctgccattttgacaagttctccgtaacggctgacttcagaaggcggccccgtgattccaatgacgccgattatttcatcatgaaatacgatgggaaggtttacgccgggcttcgttcccgttaaagccgagcattcttcgggcgtgatgctgataaccttttcagctgcaagtgcgtccttcgctcctgcgtgttcatcaccgattctcgaacggtctcctgaagcgatgataaccccgttttcatccatcatattaatgttgtgccgaataatcgacatggttctttcgacaatttcctccgccaattcttttgataggtaattcatttcatcatgctcctgcctaagatcgttttttaaatggtgattgttccgtcgatccagccttttatgaatgattttaaagaaggtgcgacccatattcggctgtcgtctatatgattccaaacataaatatcatttttccgtatggagccgtttaaaatagaataagcaaataaatcgccattgcccgcacctgctataaagagcagacaatcaaacggcttaaaacagtcggtacatctcatgtctagattctcttctattattctgtccgcaggccaaatgagatgatccccgaaagtatcattaatgccgtttgtcatttttaaaaggctgaccagttcatcaggaaaagagacgccgaggagttcttctgctttctgaagctttcctgtttcaataggtctgttcagcgtgtaatcttgaggcaaacggcttataaaatgtttccacaatgccatcaccctttgcgtttattattatttttgcatataatgagaagcgtgaacaataaaataaattttttataaaaaaatcccttgacttaaaaagataggacatgttatattaattcttgtcgatacggaggaatacccaagtctggctgaagggatcggtcttgaaaaccgacaggggtgtcaaagcccgcgggggttcgaatccctcttcctccgccattattgatttgcattttagtgattgaaaagcataaattggagattgtgttgccgctgcctggatagggcagcggtttttttttatatgcagcaaaaagagcggctcttcaagggaatccgctctttttgcttgtttatctttgaatggcttcactgattttttcaatgattggatcgagagaggctgagttgttgaacaggtcgtattcatcaatattgactctgacaaccggacaggcgttaaatccgctgatccagttttcatacctagtgtacatttcttcccaatacgatctgtcggttaacagttccatttcccgtccgcgtttttggatgcggtcgagaatcgtttccaaatcgccctctaaatagactaaaacgtcggggcgggggaagtaaggcgtcatgaccatcgcttcaaacaggctcgtatacgtcttatagtcgacttttgacattgtgcctttatcggcgtgcattttggcgaaaatgcctgtatcttcataaattgaacggtcctgaacaaatccgccgcccgattcgtaaatgtatttttgttctttgaagcgctctgccaagaagaaaatctgcaggtgaaagctccagcgttcaaagtcttggtaaaaagcctccaaataagggttattcacgacctcttcaagagaggttttaaatccgagcctttttgcaagctcttttgtcaatgtggatttccccactcctaccgttcctgcaacagtaatgatagcatctttcggaatatcatatacactcattctatatactcctttacttgatcggcaattcgattgaaaacggcttctgagattacgaagtcttcctgatctccgttaatttcaatgacgggtattggcggatcggattctttaaattgcttaatggccgcctcataatcattgataagctgttccaggtattgcttgtccatttcttgttcaaacggccgtccgcgttttttgatccgttccaataaagttggaagactcgctcttatgtaaatgatgacgtttggtttcggcagatcttctgtaagcagctgataaatttttctgtatttctcaagttttttgccttccagcgtccgttcggcaaaaatgaggtttttataaatatgatagtccgaaacaacgggcatgtgatgatgcaaatactttttctcggtatcttcaagctgcttatagcgattgcagaggaaaaacatctcaagctgaaagctccattcatctttttcatcataaaatttatcaagaaaagggttttcttcgacgatttctttgaccaaagagagtgagagcttttcggagagcatgctggccaaggttgtttttcccgcgccgatggggccttcgacagcaatgaaaggggctgtattcataggtgtcctcctactaaagaaattcatttgtgaaccatacatattgtatcacatcatcatccgctgccatgaaaaaaaacgttcctttaacttgggaacgtctctttcacaacattaaattgatcggctatcaagagccagttttgcgggaaggacaggccgagcttccaatagctgattccccttaaattcaattccctaatcagatcaaactttgcctgaatcgagcgggcgtcttcaaaccatacttcatgctgtttgccggcattgtccgtatagcggaagtttggagcctgagctgtttcatcgtactgtatcgccgcattgttctcgctcgcgatctcaatcgcccgctgggggctgattgctctggccagcggtccgcctggcgtataggggagcgtccagtcatagccgtacaagttctgtcccatgacgattttgctggcgggcatttccgtgagtgcgtattcgatcacgtcccggacgggcccgatcggcgataccgccatcgggggccctccgctgtagccccactcatatgtcatcagcacgacgaaatcgacaatttcgccgtgggcacggtaatcatgggcttcataccattgtccgggctgatccgctctcgttttcggagcaagcgcggttgagatgagccagccttcctgcctgaagcgggcccgggcatcccgtaaaaactgattataggcttctctatcttcgggccttaagtattcgaagtcaaaatggatgtctttaaaaccgtatcttctggccgctgcaacgatgttatcgagcaatctgttttttacattctggtccgtcagaatgatcctgccgagttcgtcgctgaaagcttcattttcgagattggtgacaatcatcatcatcgtagtccgatgtctgtcggcaatttcttttaagttgttcagcggcggttcttcgagtgtgccgtcccgcttcgcctggaagctgaaagcgcccagataggtcaagtatggcgaagcctctcttgccgcctgctgcaaagcggggcttacgctttctccccgaggttcgatataggcgtttgtttcaatgttccgtcttggccgaggggggatgtaaagcagcagtccgaccggtaaaacggcgctaacctgaatgcggttgatcctcgccagttcagccggagaaatattaaagcgtgctccgattgatgctaatgtatctccctgtctgacctcataaaactcgccggcgatcgggatcacgatggtttgtccgacaacaagccgattcgggttcggaatttcattcgtcgcgacaatttcattaactgttgttcggtaacgattcgcgatttggtaaagggtatcgcctcttttcacgacataaatctgaatgggaaacgcctcctttctcattgctaccactatatgatgaaaggaagtgtttcatgctctaagtttcggaggtaatcgccttagccgtcgtgatattggcgaacagaacattttccatcatcgtcaaggcgtatttgttgtctttttcattgtttgaggcgatgcaatcgcgcggaatcgtaatctcgtactcccgcatataagcatcgtttgccgtaaataatacgcagatattgcctgcgatcccagtgatgatcaaatgatcgacatgaagttcatgcagcaatgtttcaagagcagtgccgtaaaaggctgagtgctttggtttgattaaaaaataatcgctgtcattcggtgcaagccggtcgatgatatattcgctcctgccgtttttgcatttcttgataatggcagcaatatccgcttgccaaattccaaaatggtcattaatgtatatgataggccatttcattttggctgcgtgttcttttaatgccagaagatgctcggtgatatttctggtctttttggaaagaacgtcacccatatcgaattgaaaatcattaatgatgtcgactataatgagagctgaattggacaatgcgattgtctcctttcagattttatattcctttaactataagttagcctattcagtttggcgaaaaacattgaaagagtgcatgcggatgacacaagacgagttttatatgaaagaagcggtcaatgaagctagaaaagccgaagaaaaaggcgaagtgccgattggtgctgtactcgttctggatggggaaattatcgcccgcgcccataatctgagggaaaccgagcaaaggtcggttgcccacgcggagatgctcgtcattgaagaggcatgccggaagctggggacctggcggctggagagagctgttctttacgttacccttgagccatgtccgatgtgtgccggagcggccgttctttccagaatcgacaaagtggtgttcggagcgtctgatccgaaaggcggctgtgcagggactttgatgaatctcctgcaggaggagagattcaatcatcaggctgaagtcgtgagcggcgtaatggaagaagaatgcggcaggatgctgagcgattttttcagaaagctccgcgcgaaaaagaaagcagaaaagcaaagcgagctgtgatgacggaaatttgcaatttaggatgaaacaagttatactaatgagtgcgtcacatcaagacgcagcttaaataatttgatatttattttgccgtgctaagcggggaggtagcggtgccctgtactcgcaatccgctcgagcgaggccgaatccctttctcgaggttcgtttactttaaggtctgccttaagcaagtggtgttgacgcttgggtcctgcgcaatgggaatccatgaaccatgtcaggtccggaaggaagcagcattaagtggaaccttccatgtgccgcagggttgcctgggctgagctaactgcttaagtaacgcttagggtagcgaatcgacagaaggtgcacggtaaatcaatcatcaaattaagaactcatctatttgaatatagatgagtttttttcttaagaagagcttttggatttgaaagccgcatcatgtataatggaaatgatgaaaataagaggagggcgtgtttgtgagttaccaggctttatatagagtgttcaggccgcagttgtttgaagatgtagtcggtcaggagcacatcacgaaaacgttgcaaaatgcccttttacaaaagaaattttcgcacgcttatctgttttccggaccgaggggaacgggaaaaacaagcgccgcaaaactgtttgccaaagctgtcaactgtgagcgcgctccggtcagtgaaccgtgtaacgaatgctccgcgtgcaaaggcattacaaacggttcgatttcagatgtgatcgaaattgacgccgcttctaacaacggtgtagatgaaatacgcgacatccgcgacaaggtgaaatttgccccgtctgccgtcacgtataaagtatatatcatagatgaagtacatatgctttctatcggcgcattcaacgcccttctaaaaacgcttgaagagccgccggagcattgtatctttattctcgcaacaacagagcctcataaaattcctttaacgattatttctagatgtcagcgatttgattttaagaggattacctcgcaggcaattgtcggacgaatgaaaaaaatcgtcgaagctgaacagttaaaggtgcaggacggagccttagacatcatcgccagtgccgcggacggcggcatgagggatgcgctgagcctgctcgatcaggccgtatcattcagcggagaagagctgacggtggatgatgcgctgctgataacaggcgccgtgtcacagcactatattggaaagctcgcctcaacccttcacgaaaaaaatgtttccggtgctttggaaacattgaacgaactccttcagcaggggaaagatccggcaaaattaatcgaggatatgattttctacttcagggatatgcttctttatcaaacggcgcccgatttagaaggcgttcttgaaaaggtgaaggtggacgaagagttccaaaccctatcccggcaaattcccgcatcagacctttacgaaatgatcgatatattaaataaaagccatcaggaaatgaaatggacgaatcatccgcgtatcttctttgaagttgcggttgtgaagctctgccagggaccaaaagcaggggcatccgcggccgcccagccggaagtggacaatctcgtcaacaaggttcggcagcttgaacaggagattgagaggcttaaaacacaaggtgtgcaggtctcttctgctcccgcccaggctaaagaagcgtcccgtccgcaaaaaagcataaaaagcgcgtataaagcgcctgtcggccgcattcatgaaatattaaaggatgccacaagaccggatctcgaaaaattaaagggctgctggggacaattgcttgcccagctgaaacagcagaataaagtatcacatgcggcccttttaaatgacagcgaaccggtggctgcatcttcaaaagcatttgtcctcgcattcaaatacgaaattcactgtaaaatggtagctgaagacaacaacggagtcaggacgaatctggaacaaattttggacggaatgctcggcggaaggatagatatagttggcgttcccgaagcccaatggggtaaaataagagaagaatttttgcaggatcaccagccggaagattctgaagcaaacgaaccgaaagaagaagatccgctcgtagcagaagctaaaaaactgttcggagcggaactgattgaaattaaagaataaaaacatgaaagagagtggatttgagtatgcgcggtggaatgggtaacatgcagaaaatgatgaagcaaatgcaaaaaatgcaaaaggatatgcaaaaggcacaggaggagctggctgaaaaagtactcgaaggtactgcaggcggtggaatggtgaccgttaaggtgaacggccaaaaagaagtcatcgacgtcatcatcaaagaggaagtcgtagaccctgaagatgttgaaatgcttcaagatcttgttcttgcagcgacaaacgatgctttgaaaaaagttgacgaagtaacaaatgaaacgatgggtaagtttacaaaaggaatgaacatgccgggtttattctaggaggaaaataagaatgcagtatcctgaaccaatatcaaagctgattgacagctttatgaaattgccaggaatcggacccaagacggcggtccgtctggctttttttgttcttagtatgaaagaagacgtcgtgttagattttgcaaaagcattggtaaacgcaaagcgcaatttgacatattgctcggtctgcggacatataacagatcaagatccttgctatatttgtgaagatacgagaagagacaaatcggtcatatgtgttgttcaggatcccaaagatgtcattgctatggagaaaatgaaggagtacaacggactgtaccatgttttgcatggagcgatttctccgatggacggcatcggtccggaagatattaaaatacccgaattgctgaagcggttgcaggatgatcaggtgactgaagtcattctcgcgacaaacccgaatatagaaggagaagcaacggccatgtacatttcaaggcttttaaagccgtctggtatcaagctgtcacgaattgcccatggacttccggtcggaggcgatttggagtatgcagatgaagtcactctttctaaagcgcttgaaggcagacgtgaaatgtagagggaggagattgcgttaccatgggttttcttcggaaaaagaagcttagaaaagaatttgataacaagctggttgaacagctgatccatcaaaaggaagaatggaacaggcaaaagcggctgattgaaaacagcctagagccttccccagaagttctttacgaattaaaggttgccgaggcaaagtactttttttatttgcgggaagcaaaaaaaagaaatttaaggatcggcagctggaagtagcaggtctatttgcatgattcccatcatatgcttgtacaagaacgagcgaggagtgagggaattcatgggatctgttatctttatcggggcaattgtagctttggttgccctgttgtttttttcaaaagcatcatttaagcctttgcgattaatcggaagaatagcggttagatttgtagtcggcgctttgtttttgttctgtgtgaatctgtttggcgagagcgtgggcattcacgtgccgattaatattgtaacaaccggagtgagcggattattgggggttcccggtgtagcagctcttattgtcattaaacaatttatcgcaatataattttttgttgacaaatatatttaaaggtgttaaattaatatttgtcgctaatgacgaataattttttgaaaaaaagttgttgacgacatcacgattaaatgttaagatattatagtcgctttgagagcggcaacgaagttctttgaaaactaaacaagacaaaacgtacctgttaattcatttttataaatcgcacatttgttaggttaagtcctcgatcgattagtatctgtcagctccatgtgtcgccacacttccacctcagacctatcaacctgatcatctttcagggatcttacttccttataggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccctgcccgataagggcagcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactatatttcgctcgccatcacagctcagccttacgggaaacggatttgcctatttcccagcctaactgcttggacgcggatatccaataccgcgcttgccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacgagtccttccggtctcgcttcacagcccttagaacgctctcctaccactgttcgcaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtctttggcattcggagtttgactgaattcggtaacccggtaggggcccctagtccaatcagtgctctacctccaagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgtcttttcaaacttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcttttgcaactccgtacagagtgtcctacaaccccaagaggcaagcctcttggtttgggctgttcccgtttcgctcgccgctactcagggaatcgcatttgctttctcttcctccgggtacttagatgtttcagttccccgggtctgccttctcatatcctatgaattcagatatggatactgctccattacgagcagtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactactccttcaaaactaaacaagatccaaacgcacctgtctataagaccgcaaggtcttatattccgtataatatccttagaaaggaggtgatccagccgcaccttccgatacggctaccttgttacgacttcaccccaatcatctgtcccaccttcggcggctggctccaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttagcctcgcggcttcgctgccctttgttctgcccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggaagccctatctctagggttgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgtttgctgcagcactaaagggcggaaaccctctaacacttagcactcatcgtttacggcgtggactaccagggtatctaatcctgttcgctccccacgctttcgcgcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgcgcgctttacgcccaataattccggacaacgcttgccacctacgtattaccgcggctgctggcacgtagttagccgtggctttctggttaggtaccgtcaaggtaccgccctattcgaacggtacttgttcttccctaacaacagagttttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagctaaaagccaccttttatgattgaaccatgcggttcaatcaagcatccggtattagccccggtttcccggagttatcccagtcttacaggcaggttacccacgtgttactcacccgtccgccgctgacctaagggagcaagctccctcagaccgttgacaaaacaggtcggattttaaaaatccgacctgtttttgtccattttattctattatttcgatcagaaggctggcggttaggacctttccaggtccaattcgccagctttttcagattcatggcagcgaaaacaagcatcgcctgcatggacaattttttctttccccgtaaggttgtccagcgcaagccatgcttatgttttaaatcggcaaaaactcgttcgatcgtctctttacgtttggcatagatttgtttattctcttccgtatgccgaagatgatcagcttcgtctaaatgatcctgccagatatgtctgtgaatcatctttcgatgatctctactttctgtacacgtatgtagtaatggacattgtttacatcgatttggatctgaagcatactctcgataaccttgccgattggttgtgcgataggagagaatatggtcttgcgggcagatatagacatcataaaattcatcgtaaacatactcgtgttttctcatgaatccttttttggtttgcggacgcgtgtaaggcataacagggcgaacgttttcttcatgaagaaattttgcgataaccggtgttttgtatccggcatcaactgcgaccgtatgaggcttggcgacgcgctctttcacttgttgaaacagggtcgtgaacacttggctgtcatgaatattggcaggctcaacaaccgtccccagcacaaatccgttccggtcacaagctgtatgaaaaccataagcaaaaaggcgttcccgttcaccctttacaaaatagccgctctcaggatctgttgtactttcttttatttctcgttcttctgagcattgcctgggctttaagggctttttgccgttggcttcgcgatcggcattaatttcttgatctaactgttcctgataagctcttgtttcttttcttacgatctttttcacaaactttttcttattggcattcgctttgacatgtgtgctgtcgatgaaggcaaccgaaggatcgacgaggccgagatccatggcctgacgtaaaatcctatagaagattgtttcaaataggtctgtgtcatgaaagcgacgttcatagtttttactgaaggttgaaaagtgagggattttttcagagaatccatatccaataaaccagcgataggctacatcagtttcgattcgcttaatggtttcgcgcatggagcgatgaccaaacacgtattgaatgagcaccattttaatcagtacaacaggatcaatacttggacgcccttttgaagaataaagaggggcaactttttgataaataaatgaaaaatcaatggcttcttccatcttcctgaccaaatggtcttcaggtacaagctcacttaaggcaacgacttcaagctgttcacgctgatctttagagtgtttggtcaacatggtaaaacctccaaaaattagattccacacacattttaacaaaaaaagcttgtcgatcaagccacttttttgtgactttgtcgacaagctgatgaactgacccgttaaaatgagacttagaaaaaacacctatgctgcctgtcccctgtattccagtggggacaggtagtttaattttgcctgaattcgtacatgattatatcgatacatgtattgatttacaatttgtactactttagaattggatatagatgctctactttgagcgttaaatccttccgactttagcgaggagtgaaaggattcaatgacggcattatcatggcagtttccttttcgagacatgcttgtggtaatgcctttttctttggccaaattctgatatgcatgtgaagtatagacagatccctggtcgctatgaagaagtaaccctactggtttacgtaattctacagcttccctcaatgtgtctaatactaggttaatatcttggctcgtacctattttgtaagccactatttcgttgttatataagtccataatcgttgataaatataacatagtcgagccataaggtaagtaggtaatgtcggttacccatttttcatttaatcggcttgctttaaaattacgattgagagtgttcggcacaataatattactctcaccacaaatgtacttttgtcgcttcttcttaacttgacactgaatctcaaacttttgcataattttttgtacagttttgcggtttacatttatcccatactttctgtttaagatggatttaattttacgatgaccatagtgatagaagtttttcttacacagcttgattactagctcttctaatgaagttagctcaacttttttatacttctttttccaacggtaatatgttgacttaggtatgcctaatactccaagaatatcaattattttaaaagtggctgagagttcttctacaacttggacaatgactcgtggctccaactcctttcgatctcctggtacttttttataattgccaattgagcctctagctgtttattctttagttttaattcttctagctcactcatttcctccgattctttaccgtaggaatattgttttccaacttgttgcgaaaatcgataggtttggcctgttttgtaccatcgcatccatgttttaatttgagtcttattttttatccccagttgttccattatttctttgtttgtcattccagcttgtttcattttaattacttcccattttacttcttctgcgtaatgtactcttgtgcccatagaaaaacaccctcctaagaatcatattgtattaatacgattcagggggtgttttttccttgtctcatttatttgggtctctccagagccaggatcaaactctccatgaagtttgataatgactacgcacacttgcatgtacgatttatttaatgaattaacaggtacgttttgtcttgtttagttttcaaagatcattgttaaagcaactctattattatatctcttttgatataaatagtcaagtgcttttttcaaaaataaatggtggagcctagcgggatcgaaccgctgacctcctgcgtgcaaagcaggcgctctcccagctgagctaaggccccgaataatggtcgggaagacaggattcgaacctgcgaccccatggtcccaaaccatgtgctctaccaagctgagctacttcccgttatatataatggcgcgcccgagaggagtcgaacccctaaccttttgatccgtagtcaaacgctctatccaattgagctacgggcgcatatatcaatgccgagggccggacttgaaccggcacggtagtcacctaccgcaggattttaagtcctgtgtgtctgccaattccaccaccccggcgtggatggttggagcggaagacgggattcgaacccgcgacccccaccttggcaaggtggtgttctaccactgaactacttccgcagatctttttttataatgcgggtgaagggactcgaacccccacgccgtaaagacactagatcctaagtctagcgcgtctgccaattccgccacacccgcataaaatggtgagccatgaaggactcgaaccttcgaccctctgattaaaagtcagatgctctaccaactgagctaatggctctttaaaagagacttaaacattatatcataaaaaagtggtgccggcaagaggacttgaacccccaacctactgattacaagtcagttgctctaccaattgagctacaccggctttatcaacaaaatattataatggtggaggatgacgggatcgaaccgccgaccctctgcttgtaaggcagatgctctcccagctgagctaatcctccgtttgcacttgcgtgcaacaaacaggagcaacaggcccaacaggagcaacgggtccaacaggggcaacaggcccaacgggtccaactggagcgacaggcgcaacaggtccgccaggagcaaccggcccgacgggagcaaccggagccacaggctcaaccggtccaaaaggagtaacaggagtaacaggtccgacaggagcaacaggcccaacgggtccaacaggagtaaccggggcaacgggagcgacgggtccaaccggagcgacaggtccaacaggggcaaccggcgcaacgggagcgacgggtccaaccggcgcaacgggagcgacgggtccaaccggagccacgggagcgacaggtccaaccggcgcaacgggagcaacaggaccaacaggagcaacaggaccaacaggcccgacaggcgcaacgggagcgacaggagcaaccggtccaacgggagcgacaggcgcaaccggtccaacgggagcgacaggcgcaaccggcccgacaggggcaaccggagccacaggcgcaacgggatcaacgggtccaacaggtccaacaggagcgacaggtccaacaggagtaaccggggcaacgggagccacaggcgcaacgggagcgacaggcccaacaggggcaaccggcgcaacgggagcgacaggagcaaccggtccaacgggagcgacaggcgcaaccggcccgacaggggcaaccggagccacaagaaaattcttgtgaatgtctactttcgttatctagttttcaaagaacacgttggtggagcctagcgggatcgaaccgctgacctcctgcgtgcaaagcaggcgctctcccagctgagctaaggccccgtgtataaagatggtgggcctgagtggactcgaaccaccgacctcacgcttatcaggcgtgcgctctaaccagctgagctacaggcccatcttttgattcatatgaaggaagtatatttgtgaatcgtctgtccgttatctagttttgagagaatgctctcagaaagccaaaggcaaggaaactcggctaaaggccctcacatcctgtgaggaacgcccagtaccttcgtcctgaaggcatagtttggtggcgatagcgaagaggtcacacccgttcccatgccgaacacggaagttaagctctttggtcctgttggacccgttgctcctgttgggcctgttgcccctgttgggcctgtcgctcccgttgggccagttgcgcctgtcgctcctgtcgggccggttgctcctgttggacccgttgggcctgtcaatgatctttgaaaactaaacaagacaaaacgtacctgttaattcattaaataaatcgtacatgcgaatgtgcgtagtcaggggcctgcacgatgcaggtcatgcagatgttgtcctcctgttggacctgtcgctccggttgccccggttactcctgttggacctgtcgctcctgttggacccgttgatcctgtcgcccctgttggacccgtcgctcccgttgcgccgcccctgttggacccgttgctccggttgccccggttactcctgttggacctgtggctcccgttgcgcctgtcgggcctgttgatcctgttgagccggttgctcccgt
